United States Patent 10,767,156 (POLYNUCLEOTIDES ENCODING BREX SYSTEM POLYPEPTIDES AND METHODS OF USING SAME) - sequence listing, part 16

SEQ ID NO: 6222 - DNA, 3544738 bp, Methanospirillum hungatei JF-1 (residues 1,772,370-3,544,738 of 3,544,738)
catcaatgccacggaccttggtcttgacgttacgcttgatataaagaacccgaatatattcggggtgacgtttcaaaaaatcaccgccgatgtcacatatctcaaagatggaaactgggaaccgctcagtcatgttgagacaggaactattaacatcggcactggtgaaagtacggttctgctcccggtgtctgcaaagaatgcagaccttattaaagcaggatttcatatcctcattcaaggggagataacaatccaggttgagggtattgcacagccgtccttctttggatttgctccggagatcccgttcagtaaaacgaaaactatccccatctcactctgatagagatgaggaatcaggtggaagactcaccctgacaatttttttccggcagggggcatccgttatgaagcaggtattctgatccccaggcacagagcgactcgagcacaggaataaccgaggtcccaagggctgtgagggaatattctacccgtggggggacttcaggatagattttcctgctgataaccccgtcgtcctccagttcacgcagttgttttgtcagcatccggggtgataccatcggcaaccgctcggtcagctgggtaaaccgaagagtccctcctttgagctgccagatgatgagggccttccattttccgccaataacggccagggcggcctcaaccggacaatgatacggacctttttcattcatgtatggtgttttactattaattagaatgcaattatttataatataattactaccaatagtatagtaatgatacgttaggaacaatcgtgggaacgaatagaaaaggttctttcttacccctgatgtatccttgtatccaatggagaaaagaatgccagtaatatcaattgaaatggggccgaccgctctggaaaagaagcaggaactcatacaggcactcaccactgctgctgcaaagatcctaaccctccctgagcagtcattcgttgttctgattaaggaatatccccttgatgccatcggtgtcggtggacagtcattgtcacacagaatcttataatcggaagatcagtaccaggaaaaatcaaaactagatattcacacgtcgaaagagtacgattaccatgactacaatcaccatcgatccgtcaaaatgtaacggatgtaaaatctgtatgtccctctgcccctattgtatccttgagatgaaagaaggagaaaatgtcgcttctcccaacccggatatgataccgttctgcagcaaatgcggccattgcagtgcagtctgcccacagggagcaattgatgtggattatgaaggggccggaccaattcccgactgtgcttctgattcgattccatcatttggggatctgagcagactgatgatggtcaggcgttcggttaggagttataaagaaaaaccagtgccccgggagatcctgcaaaaaatcctcgatgtggtcagatatgcaccaaccggcatgaatggacagttggttcgctggctcgtcgttgaaaaccctgatgaagttaaaaagattgttgccggcacggttgaatgggcctgcaaactgatgcagacagatatcgaacacccgctcaaaccgatccttccgatgatcatcgatgcatgggaacggggagaggatcatgtttgtcatggtgctcctcacctggtggttgcctatacccacaaacagaatccgatcgggtttattgatgcaattatcgcccttacccacgttgaccttgcagcaccggctcttggccttggaacctgctgggcaggaattgtacagattgcatggaatgaatcaccagaccttgttgcacggctcggactgccggcagatcatattccgatgtatgccatgatgatcggatatccacggtacaaattttcccagataccaaaacggaatgctctgcaggtcatctggaaataaaatcagggatgtaactggtcatcaagccagtctaatttttcctgatatgaaatgccggatgcccccagctgacaatgttcaccggcgcaaaactcgtcggtaaagactaggtatgtctttgggcatttcagagcctcataaaatgactgtgcctgaccgccaatctttgagtcacttatcccgtcacaaacaagggttgctgctgtgatgttctcaatgacaccttcaagtgtgtagggctcataggtgagcatcacatcagccggagtagggacatcaaacacatacattccctgagtcatggcccagtccagactggtcgaattcttcatcctggcatacatatcctcgttgacatagtccttgttttccctgatgaagtcaaacacatcttcacgtgttacattctgggggtccgggaatcccattctgaactgactgatctgttcattcgccatgtcatagatagcactgtcggctatgattgcatgaatccggttatcaaacgcagcagcccgggggacgaaatatccccccatactgatcccccacatacctatccgttcagaatcaacatctggtctgctcgttgcataatcaagaaccgggcctactaccttctcccagtcatatctgaaggggatcttctgaacacggatcacctcaccctgtccagggccttcaaaggtgagcacattataccctctcttcactccttcaagagcatttgagtagagttcctcctgggttccatcatacccggtctggattatcaggagaggtttcttctcacccgactcatctgcagagtagaaatatcctgggagggtggtattttcatagggaatcgacacaatctccatgtgaaccggatcaagttccatagctgccctgaaggtatccacactgttcttccatgaggtcagaatccgggggtcgtctggatttcgatgaaggaagaattcagcagtccggtaataggtctgggcacggagccaggcatcatgcgctgaaaccaggtggccctgttcatacgccgtatcaccgacttttttaaaatgatctgcggtctttgtccattctgtataccagttctcataattgagaggttttatccgggatgctgtggcaatgacctctcccagatcagatccaccggagtacatactggaaagggttcgtttcagttcaaaatcaaactcagggtcattaaccataaaaggggaacaggttgtattcacattgatgaccggctgtggggagatctcatctgttgcagaacaagacagaatcaaaaatccaaaaagaattactccacctaacagcagataccgtacaggaagagacatgccaatatcttcacagggaaaggaaaaaaatattgctgataaatccggataccagagaggctgtttaataaaatgtcatttccgcaagagtacaatttctattcgattaacgtaaatcgccgataaaagaacgggtttttacctcattatacgatcggtttgaagttatgaaacagcctcaaaagggatttataattatttactcatcatataccggcgaagatcaatcccccgaatacgacagacgggaccatcacggagtgctggcagaaatccgtctgcaatatactctaacagtaccgactcactctcaccggcaatggcagcagcttctgacacagtatacagaatctcatccatgactccaccgattgagtcacggagcatccggtcaccagcccgttcaggccctgcaaaccctgacggaataagttcttcagattctattccggattctgaaagcgaatactggacatcatccaccgagatcggggcgggagggatggcacttccttcagactccttctcttcagcgacggaggattttgtctcctgcagcaccggtctttgcatggccgcacgggggtcctgaatgagagcagggtactcatgcctgatcacatgagtcgtgggagagagagttgaaagccgggctatttgtccccgaagccatgatatctcctcgtcctgacggtgtattatctcacgcagaatctcatggtcggtcgggacggaggcagttttccgatcgcaggatacaatcctcgttatatcatgttttttaatattgagtgcctggctgagcagatcacctgcaatatcctctatggacatgttctgctctgtagcgaagtgattgagccggtttataatttccggagagagggaaagggtgatgatctgtttctggtgagacatcttctcccagtctaattaatttctgaacacaaaaagtgatctcatgagtatgaatccagccccgattgtgtgaattttaaaaaataagcggatttatgcaacctttttcttcgctcccaaatatcgtgaagactgaagggaattgagccgtaataagccgaccagaagaagagcgataaggaagatacattgaccaattacaagtaccgggaagatattgatcatttctggtaaagtcattatgtcagatatgcggagctcggtagatatggggccggccatatacatgaataggatgattgtcgaacagaggaggataaagaatcttataaatttattttttactggtattgagaggcaatagagcggcagtatgactgaaaaatagataatcagtccggcagcaataagaatgagggttggaaagaggaatatcaccggatgaacagagagcgatgagaggaaaaacccgacatcgcctgttacctcaaagacccgcatcggaatataagagaacagggcaccaaggttgaagatgagcacccagagggaaagtgtcataaggcttttgtatttaattccacggcttttcaggaatatccagaaacataagactgctgccagagcattgaacagaagacctccgatcgcagtcatggacgctgaacttacatctaatccagacatataggggatatactgaaaggattcagaaaatccatatatgccagtctgataccgggtgatgtgtatcggggttgtgatgattgcctgcattggatcaggtgtcatggtgatccccatcatccatgcggtggcaaaatgacccgattcatggataaaatattcaataatacgaccaatgatgatagaaaccaatgttatgaggataaaagggaccgggttactccagggtcggaacttcattcttattcttcatattcgctggaagaaggttaataattcgtgctctgatatgatgaagcagagattaaaaaggaactttgaaagatagaaaggaatcaaaaagaggcaggatttagaaaaccatgactctccaagaggtattatggagggagacggtgttccagtataccaaagttttgtcctcgccggatggtactacatcacccagagagagcatatcatacccggcaagataggttccaaccggtgatgaggcaaggtcagcgatcttctgaatcgcagaaggatcggataccgtggcaggcagagacccttcatgcccgattatggtgccatcaggctggatcaccaggatgttcaggtccgtcccgtttgtcaatgaatccagggagctctccaccagaagagcgggatggaggagcaccgagaggtatccggtaactgagagcgatgaagagtagaccggataaatgatacttactgcaaattctccttcgacagtctcgaaatactcactcatgccaggggcaggattgcggataaccgaggcgaccatcgtctggtttttgacatttgaaccaatactgctgctgtatttttcaggatatactgcaattatcgtgccggagcggtcaagaagacttacttcaaatatggcagggttgctcttcgctactttttcaagatagccttgtgcatcaggaccctgcagattctttcccttgagctctgcggcatatgcggcgatggcggcatcacaatcctgtaatgtctttgaaagagcggtagaagacctgagttgcagggttgttattgccagttcttcttcgggtgacagaaaagaggtttctccctcataccagctgtctgattgtgtaaacccctcatgctttgtaatcgagaggatccgaagtggctgcccccacatctggatagtcatcacatctgtatcaatgactccggtaatgtctaccaacaggccatcctgtttgtattcatcaggcagatccaatggaagatactgtgctccatcctgagcaataaagccataaaaacccccttcaagatcgatgtaggtaatagtcccgtagctcgtgatctctaaaccggtctcctgtgcaatacaccccgcagcacagagaaatgagagtgcaatgaaaaaaacacccaccgatgccattgatcgaatcatacatttttttcggcggaacacaagaaaagagttctggtatagaggtttataagagagcaccggaaccacaccggcatcaaccggagagaaacgcggagagaagcagggcatagataccggcatgaataaggataaacacggggaccattatggaaaagagtggttttcgaatcttgtgcctgaagatcctcatccctgcataggcaccaaagggtccgaaaaatgccacggttatcagattccgttcagataaccggtactcttcacgcatagcccggtgtttgtcatacccgaataatgcaaaggatatgatgttgagaatgaaatagggaataaaaaatatactattcatgaaaacgtcctttcttatctttcgtatttttcatatttttttcccatatgctccataagtatctttttagagaattccgccctttattatctcatctgttgagagaactctggcatagagccctgacagggcccccatataggcagcatggaccaggggagcagggacagttacttcctgaaacgtcagatcacgggttgtacatgcatcatgagcaagaatacaggcaaatccaagatctgctgctgcccttgtcgtcgcatcgatacacatgtgactcatcattccggctatgatgagattgtgtaccccccttttctgaagatatgatccaaactcagtctgcctgaaactgttcggatactgtttttcgatgatcttctccccggcttttggggataccagatctgatatctctgctcctttggttccagggaggaaaaatgtcgcattcgggcgtgttgagatgtgtctgatataaataggttctatgccacgggtccgggcaaaatccaataaaagactagcttttttcccggcgtcaagactctggtggcattccatggcaccgccaggaaagtagtcattctggatatcaataaggatgagagcagtgtttgtcataattcccccggatttgctaagatatattgtcgtggatgcagcccgaatttctggtagaaggggagcacatcttcatttccgacggttacatggaccctgatatcggtgcacccttcttctttcatccaggtcagggcatgaaccatgagtgttgtcccgattccccggttcctggcctcatcacacacaaagatggactctatctctccataggaaccgggggcaaccgaacagtaacaatacccgatatcatccccggacagggtgtcgacggcaaaaaagatgcgaatcaaccggtcagtgttcttctccagcaggtcatttttccggtcatgaaacctgacttttctcatctgcccggagaacattttattgcgggatatgatgcacaccctgagctgttcccagagtttttctatcctgtgggtctcttctggtccggctgcatggatctcatactgcacatcaacagagttctttaatttcgactcctgcttctcctcttctgcccggtgcgcaagttcctgagcaaaggccgggtggcatacagcgatatattctgcaccctcaggcgtgctgtatctgactctggatcctgcggggaccagaaccgcctgtccggatggcactaaaaacacctgaccatcagtctctacctgcaatgtcccggagagcacaaccgaatattcatcaaactccggagtctgatatggctctgaccagccgggggggcttaccatccgtgcaatactgacctccggtgttccggatacgattcttcccacatattcttcaattctttttgggggcgttccagttgcactgatgatgcggggagaggatatgatccggaccatagtatcaggtcttttgttgtttctatatgattattgggagtgtgaaccgaaattaaaaatgatgattctgatgaacctgtatctgtgatagtccctccccataatttctccaaatctccggtgaaggaggtcatctgccggtactatacatctggcaactctcctgttgagatacttattccaaaaccatacccgggatgggaggtaatccggaatgaaatggctgattcacttaataggtatcagaatgagacctttcatgatttaatgctcacatataccgatgagttccatctttttccagatgatgaaccggtccatctgatatctattgccccagatataccaaaatcactggcaaaactgatgctgtatggattaaaaatggagattatcctaccgggagcggagaaagggactctaatacagatcagatacacatggaaaaccgatatgattattcttgatttccaggcgatgagtcaaaatgaaaaggtatatgcaagagatgcgacgctgaattggtttgagaaggctcgtgaggatattcatttggtatttgatgtgattgtatcagagacgttgcggaaaagatgtttataataattccaccatctcatctactcttttcttaacatcttcaaatgctattggctgagaatattgttgtaaccgggataatgtaatcgatttttgatctctgaaatgcttattgatatcagaagtcctaaatacgtaaaattcccattgagccagatcaaaaacgcagacattatcaggattcttctctgtcaatacgcaaaaaatatacaaatctgctgatctcacctcatggtccccgtatttgtttgtactggcatcccagggtatttttttggcaatatcaaattttataagagagggtttttccatattccagctttgcagatagccagaactctttacttcaatttttaaccctttataacaaaaatcgatgtaattccattcaacccttggtgattctgtcacatcaagagcatagccgacaagaaattcagcaaacaggggccgtacagtattacttaaaagatctgaatatgcccatgaccagaaatcgccaatctttaccccaggaagaccagttatttcctgatctactgaaatttttttattcattctcatctataagttactttttggggtggatttttaaattatcgattaacccttgctttttgctcaataataaatttacaatggtcatgcccagcagaataacattcaatctccgttattctcaccggctcattcagatacccggagaatatcgcagataataccccgatatcaaacgagcaggcaccatgaccggtaaccgggaggtcctcacactcaaaacatccctgaacagtgagagagattggatcagatccactcagggtaaccgatccaagaccatgcactgaccagaattcatgcattttctcaaccatccgagagaggtcggaatcatacaccaggggggcaaggaccctgccaatctcccatcccgttcgttcaagcaccggatcaacattgatcccaagagccatcgcctctgttctgaacacccggactccccatctgaaaaaggatgcaatatctcccggttcaaatgggagtcgggcagatacctcacttttatcctctctgaccggtgcatgccgatcaagattggtcagccgcccgatgggatgtgaggtaagggaaagtatcttttttctgctgtcatctggatcagtatgtgatgagataagacctgctttcaggagatcatgaacatggaccgatatggtggattttgcctttccacagagtgtgacaatctcataaaatgaatgatcccgtgactgcaaaagctcaagtatcctcttcttcacctggctgtcaatcgccataacccgatttctggatgagaagagctggatatcatcatccagattctttgtatattcttcggtcactgctgcatgtacatataatccggaaggttcatatttgttcgcatacaatagaatgttcgtacaaatactaacgagttgaattatgaaagcaagtgcatataaaattgcagaaggagtatactgggtcggaacactggactgggaccttcgatcctaccatggatatactcttgatggaacgacatacaacgcatacctcctctttggtgaaaagactgtcctgatagataatgtctatccagggcaggctgcacagatgtggggaaggattgctgatgcatgtagccgggaaggccgggatctccatatcgacatcatcgttcagaaccatgtcgagaaggatcattccggagctcttgcagagattcataaaaaattccctgatgcacccatctactgcactgaaattgcagaaaaaggacttgtaagacattacccaaccgtacagggagcagagttcaggcatatcaaaaccggagatacccttgactatgggaagaagaccctggcatttgttcaggcaccgctcctccactggcctgattccatgttcaccctccttgtggaggatggaattctcttcccaaatgacgcatttggtcagcatctctgtttcaccaagcgtcttgacagcgagattcctgaagcggttctgatggatgctgcacagaagttctatgcaaatcttatcgttccgctatcagggctgttcatcaaaaaagcaaccgaattgacaaaccttgatctcatcagcaaagtgaagatgattgccccgtcccatggacagatctggaccgatccatcaaagatcatcaatgcatatatcggctgggccaccgggactctcatcaaaccaaaggttaccatcgtctatgacaccatgcatggatccacccggatgcttgcccatgctctcgcagaaggggtcataaccggcggatgtgatgtgaagatctttaacctgcatgaggatgagcggtcagagattgtgaagcacattctggagtcaaagggcctgatgattggtattccaaccattaatgacatgccgtatccaagcatcggggatctcatctattacctgaaaggtctgcattttgaccggaccggtgaacgctatgccatgaccttcggctcaatgggcggaaaaggcggtgctccggccatgattgcagatgaactgaaaaccgcgggatttactgtcacaaagaccatggaagtcgtatttgttccaaatgccgatgaactggaacaggcgttcgatgcgggttttgagatagcagaggccataaaaaataaagggattccagcctgatccccttttattctggagtgagatcctcaaaggtatatgtcgaatagatcattccaagcatctcaacatctgaatcagacgaggtgcataccacagaagggttctggtggacagcggtaaagagaatatccggatttggctctccgctgaagggttcgtccacatcggtctggatggtaaaccggtatggatccaggttaccaaagaagaaatccttgtactcggtaacctgttcaggggtggcattgtaggcccagtccgctgcatctgcaacagtaacatcaacaggaatccacccatattcggggaggtagaactccgcccagaaatgcgttccctgatgccctggtactatctgatacccgcctggagcccgtgctggaatgccgaccgcccgacataatgcagcgaaataggtactctgggttccgcaatcgccaaagccggtataatgtacaaattcagattccggaatggacattgcagtgagatatgcatgaggcacattgctgtaaggaagcgtctgtaagatataatcatagatgagccgtgcctttttatacggatttgtttcatctccgacgatctggtttgctaatgccataatttccggagtgacattgatatttggctgacttttcgtataccgctgatacagaggatctgatgtatcgtacaccggaatcgcatcaggatcgagatcaagaatccgcgggcttgtggtaaacgtgagcctgactgagacattcacataatcgtccatcatcttctcaagaggtatctccaggtatacctctccgatgtcacccgttgtcaccggttctgataccacatattcttcaggctgaacagatgtcaccaagatatctgactgactctcaatactgaccggaagcggataccagacctgcaaagtcccgttgtcaggaagaagatttcggggaatactcaactctcccgttccctggaaggtatgattcagatagagcgggttcttcttatcgcgtggagcactgataaacggagatatctgatcgaaaaacggtgattcaccgagcgatcgggtatagttctgactcagggaggcgttgtgaaatctgatatttcgggcaataccttcataataatagatctggccgtcagattcgaactggattgaggctcccggttccaggaatgcctcccgttcttcctgagtgaattgaggaaaagcctcctgaatagtctcatctgcgctcgtcctgttcaggttcatctcggcaaacagccaactcattcttttagcctggcggagagcatctttcttttccgcctcattaccgagtgcagcaaatttttctgaggcgttcatgaaaagattataggcgtgttcatagttcccgtctttgactgcattctcagccagttgaagcatctcatcggcagattgttcagaagcgccgatagcaattcccggtatgacaatcaaaaccgtcaaaaaaaaagtaatctccaacacgcgactacccatcttaactcccatataattttctttatgggtcaatgggagattaattcttcgaactgacgaccacacatgaaaacgtccgaaattcaggggattttcagagagagaccaccaatgtccttggacggcatcaacacgaaatttaaatacccagtcaccaactactctccatgctcaccttcatcctgcttggcagactgacaaatcttgccgttgaacaaacccgtgaattacaggagagagataaaagggctgccgaaataatcaaaaatgccggaggtaatctggtttcgctctattacacctttggtcagtatgattttgtggcgattattgaagccccgtctcaggagatcatgggactgattcttctcgaaatcggcaggttcagcaccgtcagttctgaaacgctgatggcaatgccacctgaacagatgtatagccttattcataagttaccctgagctatgtcagagtcctcaaagctccttttttcatgaactccaaaacaagagcaggaggtaacagataacaggcacacatcaatatattgaaagactaatatttcaggtataagatggtttcagatgtcgggtatctggtcggcgcaatcgggaccttttttgcaatcctggatccgttcggaaaccttccgttttttattgcatacacgaataccctcagtgccccggtacgaagaaagaccgctctggtcctctcggctttcatcttcgtcgcgatggcagtttttctcttctcaggccagatggtcctgagttttttccacatatccctccctgcgttccagatagccgggggaattattctgtttggcgttgctctttccatgatgagcggtactcacacgataacgatgaaccgggtcatatcagacaccggaaaagagatgcttctggagaagaacgaatctattctccccacaataattgtcccgctgggtataccactctatgtcggacctggatcgattgctgcagccatcctctttggcagtaatgcaccgaccgagacggcgtttcttggaggtttgctcgtcatccttcttattgtcatcttcataaccatcctcaacctcagctcagattatatcgggaaggtgctcgggaaccagggaattgagatcctagtccggctgatgggactggtccttgcagcgattgcagtccagctgacactggatgggattaccggagcgatcaccaccatgatcctcccctccctgtccggataaattacagcctgattaccatatcatcagtaccgatgattacatccgagaactgaggtccaatattcctgattgagagccgctgatcaagggtggtgtacagatcggcagcaaaatgaaccagtgccagctggtccgcccctgcctctgttgcaagacgaacggctacttctgggtttaaatgaggccatccggggttttcctgtccggggagataagcacattcagtgatcaatagatctgctcctgccccaagtgtgagtattccctcgcagggtccggtatcggtgcagaatgcaatcgtttttgaaaactcaaaccgatacccgaagaccggctgggtatggacaagaaatgcagtctgtaccgggatgcagagatcagacctgccctccggaagctcagtgatagttaccggataggtcagttcatcaatcgggacggtgtagggatacccgataaatccggatagtatctgaaccccgggcggaccatagatggacaggcctccttcaaaccggcaccgtgccagggtatgcagcccggatatatgatccaggtgaaagtgggagaagaacaggagggcgggttttttgatacagaggtacacatccgggatcttcgtaaatccctctccggcgtcgagaatgataaaacagtcaggggtatcaatggtgatgcaggtggtgtacccggtttttgaggtgtaccacccgtttgttccatgaaaaattacggtgatctcttccattatctcatgagtatttcgatttaagaacagatataaggagtgttccggcctctacctgaaattattatttttgaaaatagtgagctgacctcagtagatatatctctgcgatgatctgcccctgataaccccgatcactccatatgcaatcaggtaacacccgataaatacgataaggagtttcatcccgtcctggggatagagtataagataaaacccgataacaatgctgagcacccctccgatgatcagaaaaaaccaggataaccggtcctgaacgaaccctgatgaaaacccgagttgcatgatacccatcatgaggatcacgacccccagtaatattcccatcagtgagaccgtcatgtcagggttgaagagagcaaaaagactgacacatacaccgatgaggcccaatagaatgaacggtacagaaaaccctgatcccctcaccgaataaccaatacccacaataatcagcgatatcagaaagattatcgcggcaagaaataccccgataatacctgggataaaaggagaaaagacgagcatcagaagaccgatgagtattgcgaccactccggccttttgggatatacccctgctcacccagatcatatgcatacaggaaggttgttccatcatcaataaatccgaattgatcacagatcggtggaatgattattgcagagcaatcttctgcatgagagccatgattccaggttttgtttttcccataccggtgccggtctgcccaggtccaaaacccccgaacatcggaggagcttcaaacatctcggtattcatccggtcggtgatctcatcaaatatccgcttatatgcgatacaatgaggatcaacaccggttatctcccctccggacggggcaatcgcattataggggcatcccccccggcaatatttgttgtgggagcaggatgagcaatgggtatccacgtaggccttgaaatcattcatgagtctgccaggctttgactcatcaagatccttctgcgtcggccggtcacggacattgcccatgacatactcatccatccccacgaaccgataacagggatagatactcccgtcaggaccaatggcataggtgttccccatacaatcggcaaaggtgcagacattccctcttctcgtaaagacacacctgaccaggtcattgatattcataatatcaatctcatgatagtggtcaagtgactgatccagaaggtaaaccaggagatcgccaaatttctccggggccagggcccactcgttcgggctctcacttcgtaatgaaggaagtgccgggtgcagtttcatggtaaagccctgatcgatgaagaactgcacgatagattcccgctgtttttcagagtaaccggtaaacgtgcagataaaccggatattcaggccatgctcccgtgcaacccggtaccctgccatagttttttgaaaatacccgtctccccgctgataatcagtaatatcctcaggaccatcaatactagacccgatgggaatatggtattctgcaaagatgtccgcaagttccggagtcatccgccagaggtttgtctgaatcgcgaatgagggtttatttttcgcaagaccctgagcaagaagaggcagagcctgccggtaaaagtcaggtccggcaagaagaggctcgccgccatgaaatgttatcgtgaccggatcatcccgaaaatctgaaagccaggatacgacgtccttcacaacctgaatattcatcaccggagatccttcttcagaactccagcagtatttacaattggacgggcagccaagggtcgggataagcatgatatggaaaggggttttcatcagtccaccactattctcctgaataggtactaacccaacgacctaaaaattagataagtcccattcggtcggcttccatcataagagagtcgcggaactgtggatgggcaagatcaattatcgcaagcgcacgctgccgggtatcctttcctttcagattggccatcccatattcggttgcaagataatgaacatcggcacgtggagtggttattgctgcacctgcctcaagccgaggcacaatttttgatatcttcccacccttagccgttgaataaaacgcaagtatagactttccaccccttgagtcaaatgctcccctgacaaaatcaagctgaccgccggtaccactaaagagagaacctgacaggtactcggcattaacctgaccgagaagatcaacctcaagtatcgaatttatcgatatcatattatcattttgtgcaatgattcgtggatcacagacatgggatgccggataactctctatggaggggttatcatccatgaattcatacatccgtctggttcctgcggctgtggtaaatacgtgcttctctttatgcattgtctttttctttccggtggcaacacccatgtcaataagatccaccattccttcggtgaagagttcggtatggataccaagatccgtatgatcctgaaggaaacctgcaaccgcgtttggaagtccgccgataccaagctgaatggtcgctccgtttggaatcagatctgcaatcattcgtccgataatctcatcttccggctttttttcagggatctgtagctcaagaagaggagtgtcatattccacaatcccatcaacatcagagagatgaatctgtgagtcaccaaagacacggggcatgtatttgtttacctcaacgataattcgtttcccgcatcgtgcggctgttgatatatagtcatttccggtcccaaaactaaaaaatccggctttgtccatcggtgaaaccgtggtgatcacagtgtctatatccataaagtcctggcaaaggcgaggtatctggtgaagataagaaggaacaaaatagctcagaccatatctggtcatggtccggtcagcaactccgctaaaccatgagtgatgggtgatctgatcacagagttcaggagaaagtacggtcgattgggtgtgttcacgaggaagaaatgtgtagatgttaatattctgaaggttttcagagagaatcctgtcagcaagggctttgagaagtgccggcggctgacatatggacataccatatacgatagtctcgtcgctctgaattgggaggactgcctggtccggggttttcagcagttcaaggtaccgggaatctgatcgagtaaatgccatgagtgtatcatatccaatataccgggaagagtaatgaagatgtaccagggaggtggaataaatatacctggtgagcaggcacgggtttctgaagcgattgcatccggcaaacccaccgccattgattggcatattaacccggtggataaacctccggtccagtcatttgcacaaggagcctgtgattatgctgtacggacactgaattaaaatcggtgagcattccttttttgattttcgcaatcaatgtaccaactcgtaccgatacggcaaactctctttcagaattcatttatgggggacctgcatacgtgtgttcatggatccgataatcagcacaattcagaaagaactgatcggggtgatagacgaaaagaccaaaaatagttaccaacggtttttcaaggaaaaggtgaacgcatacggatgtaagaccgctgcagtatcaaagatagctaaaaaatactggaaaatagtcagtacaagaagtaaacacgaaatattctctctctgtgaagaactctatcagtcaggatacatggaggaagcctttattgtatcctcctgggttccaaacctcaaagaccagtttgaaccggaggatatcaaaaccttcagatactggattctgaactatatcaccaactgggcaacctgtgacagtttttgtaaccattcgatgggtgactttatcgaaaaatacccagaatccataaatgaactgaaaaactggacacagtctgaaaaccggtggatgagacgggcagctgccgtatctcttatcataccggcaaagcgtggaaaataccttgatgatgtccttgagattgcagatgctctcctgaccgatgaggatgatatggtcaggaaaggatacggctggctcttaaaagaagcaagcagacagcatgaggacaccatttttgagtatgttcaggctcacaagcgggaaatgccacgaacatcactccgttatgcaattgagctcatgccaaaggagagacgggcggaggcaatgaaaaaggactggaaatagacaggacaaaaacaggtacatcatatagattacaggagacatcaataagaatgaatgaggcgggcatggtgaaaaggagggagtattggtgacatattcactcccggccatctccttgttatgcctgatatcagcggctatcacttttagtcttgggatttttgtttttgctcgaaatccgaagagccatgtccaccagttattccttctcctctgctgttccggagcattctgggcattttttgaatttatgctgaggcaggcaaccgatccttcatttgcatattactggaatatgatcgggtcagagtggatcatcaccatccctgtcgcaatccattttatcctgctgtttaccagtcatccattgagcaaaaaatcacatcttcccatcattctgttattattttacgcccctgccctcgtgttttttatctatgatgcgacccatgcatggacataccactttaccttcattgaaggatatggctttgattcatcccccaagccttctcaccttctgtatattcctgaaattattttcgcatttattgttgccttttttgcaataatcacctgtatcaggtcatatctcaaaacaccccaaatatacaaaaaattaagaagacagatccttctggttctgatgggtatcagtttcccatccggtgcagggcttatcggcatagtgttcttctcaaatatctccaatggactctccgtagccgtcgcaataagttatcttggatttgtcatctgtatcagtatcgcaatattacgatacggcctgttcattgtctctgcaacaacagcagcggagacgatcatcacaacgatcccagatgccctcatcctaaccactcatgatggagagatcatcactacaaaccctgccggtctgcatctgacgggacttgggaggggcaataaccaggagaggcaaatcaggaattttattccggaaactgaatttcttcagatattacaaaagattgaacgaaacggatctgtatcagacgaggagatgttgttcaggggagggtttgggccggtgccggtcagtattgctgcatcagaggtaaaggacctggatggaaaacccgcaggtcttgtatttattatcagggatataaccgaccggaaagcatcagaaagggcccttgttcaggcacgagagaaactggccctgatgtttaagatcaccaggcatgatatcttaaacctcctgaccgcgatgacaggatatttgtgtattgctgaggacaaggctgaatcccttgatgcatcgcttaccagcgatattcggacctgccaggacctagctgagaggattgcagatcatatccggatcaccggaacatatcatgaacacgagtcaggagaaccgatatggcaatccctggattcacttatcagacgactgatacaggagatgagcaatacggttcagataacagccgatatcgagccggttgagatacgtgccgaccctctcatgtacaaagtactctataatattgctgaaaacagcgtcaggcacggagagaatacaactctgattacctgtgaatcagccatcttaaacgattcatttatcctggttatggaagataatgggaaggggattcttgaggaggaaaagtcaagaatttttgaaccgggatttgggaagaatacgggtctcggactttctttctgccaggatattctcaattattctgggatttccataagagaaactggaaaagcaggatccggagcacggtttgagatcctgtttccccccggaacctggagagagaaaaatacatgacctgattaaaatatcgtattatcctcaataaaccgctcaatcacttctatttcccgttcaagactgtcacttaattcaagcgcttttgcccggctgagataccttctggcttcaaagaaatctccatcctgtttacattcatctgcatacgtgaccatcagatcgatgatcttcagattcggaccaaacggaatattccgttcatccaggatctcccggccatgagagaggatatacgacacatccaactctatctgggacttttctttgatatatgccagttcacgggcagtctctgtcgaatcctcccacgtggtgcccatcaggtaacaggtgacggcaccggtataatcaccggtttctatcaggtaatatcccatgttccgataggcatgggcaaggtcttcaggtttccaggcatactcaaaacagtggatcgtgagattgcgaaattcatccaggtttccctcttcccggcagaaatcagcacgtgcaaacaatatggaatcattgaccggacttaatactgaaagtgatgtaaaaatggcacgggctctattcttctctcccttcaaagcagcgagccgtccggactgtagcaggatatcacagttcagatagggatgaaccgtaaaatcctgttcaggcgtgacataggtgatgtaatatgcatattctataaagtcccgaaatgaacgatattttcccccctcctcatccggatgttcagcatagggaaggatatatgacaatgctgactctgcagccgttccatctcgttcgtccaggagtgaacggacagatgcaagaactgcctctacaatcagatcagggttttgaacccgggatacgaaggtctgaaattcagtttgagagaatgataagacagccagagatgctataacgtcagatatcgccttctgacatggatgggctgtataatgatgctccatatcgatgaggtattccattacctgacctttttcaccgggaacatgctccctgatgtgcgtaacaatccctgcacaactctctggtgatgtcattctcttttctcccgaatctggtacctctcataggattgaacttcagtcatgatgataaatacctttcaggctcacaagaattctagtacctgaacagacgatctattggtatgcagctccaaaagcagggtatcagggtttttgggatctccgagtcctttgcttctcgggactggtcggtcctctgcggcgttgttatgcgtcgggacctgcatattgacgggttctgctttggaaaggtcagagtaggggggatggatgcaacggcagagataatcaggatgacagccgttcttgaccggcaggacgtaaatgccatcatgctgaacggatgtgtcattgcctggtataatgtgattaatccggtggaaattatggaaataaccggattaccggtcatttgtgtctcatataaggattcagagggtctgactggtcatatcaggcatcattttcccggagatgaagagcgggtcagacgttacgaaaaccttggagaacgtttatccataccggtaaaaaccggtttatctctattcgcccggggatatggatgcaccgagcaggaggtcaggcacctctgcaggatcttcaccctgcatgggaagatacctgaacctctcagagttgcacgcctctgtgccaggactgtcatgcagcagaccaggacagaaaattctcccatattttcctgataattctacacagttattcgatatattctgcccaaccgatatcaaaggacgtacctatgcgcaattatcagattctcaggagataggaaagaaaaaattttgaatttagggggcataggtaaaaacagaagagagatacttaaagttataccggtaattgatcagctggaatacagatctctgattcatgttacctggctggtagaaatacacacagaacagagactggcggtaagaatatgaatccaagacgattgtttgttggaaacctgacatattccgttgatgagaagcaactatggggactcttctcacggtatggtgaggttgtcggtgtccgtgtcattgaagggaaaggatacggatttgtagagatggaaagctatgaagatgcacgggctgcacgaaatgccctgaatgagaccgaatttcaggggagaaatcttcttattgatgatgtaagaccgccgaaaccaaagacaggattccagcagagaccaggggggaaatttcaggggagaagatccccatccaccggaccggccggaaaacaggggaagaaagggccggtacagcagagaggaggggcaccaccaggcaggggaggagcagggagcggacgactacgacagagagagactgagtatacagaacgggtattaaccagtgtaacccggccaccccgtgatgataagaaaactgccattaggaaaaagccaaagacatcatcatcagcagatgaaaaatcatcgccaaagaaaaagacccggttctggccaggtggcagaaggtaatcacctttttttatacgaatatcctattcaaaaattttgaagagagccgaacttcttcttagcggtgatcaggaaacctttctgatgagggggctgccgggttggtaatatagcggatgataagcctgatgacttcgggattctttggcaggaaaatatggcagtactgatagggatcagcctgcagactaaccgggtcagtcgggacaagatcaaactccgttcctggaaggtatgagtcataatgaggaatcaccccatctccaagccaggtggttcgccaggtttcatcatgcccgagcacccaggtccgtccgttaaaacttgggaagaatgccggatctccggtccggtttgcagcaagaatgttcctgtacctgatgtcaggcctgattcccgcattgcataattctctggtctcccggcttctgatccgaagaccctgaacattgacatccttctccggttcatatttctgcgggacaaattcaccagagaggacatctatgacctctggtccatgtaccggatcattaaaaatctcggccattgaagagccccggtttgggacccctatctcgatcaactggcgaaccttctcctccctttttttcccgtcaagcacttcgacataataccgggtgacataaccacccatagagtgacagacaatgtcaaccggtccatgatatccggctacccttcgtttctcatgaaggaaggacctgagctggtgagcgatttgtgagatcgtcgattcatatagaccagaataatcaaaaagccagatctgttcagatgggattcgaacctgctcaataagtcttctccagatacctggatgactcttccacccatgcaccagcaccaagggaatggattccatgattaatcagtctgcctggcaggacagaagttacagattgagaagaatacatccttttccttgtcacgaatggggcaatagtactcattaccccgtttttctacaacctgaccgccaggaaacggcatcccaaccgggtgaccggggaggtcttcaacgaacatcgtatatgctgcaatcagatagtaaaaaagccggtgcctcgggctccagatctccgggttcttccacataccctcatcccatgccatacacccgtcaggtatcatccggcagtacgagagaaagagctcaggatcacgaatctgatcagtacatttcctgaaataaccacttctatacctggacaggagtatgtggtgggcaccgaatatctggtctttgaaataggatctgattttatgccggtaatgtgcaggtagccgttcaatctcaagatgtaatctcccgccgatcacctgcagctcaaataccgagtacttctgaatttcttctgcaacgatagtgccaagttcacctttgttcgccgctccagcaagccgtgcgacgattgattctatctttgatcgctctggatctgtcatcccacagcagacccgttctgtaatcactgattatacatgaaaccggagatacaatatagtttcatgcaacgaccctattgaaagcaaagactgaagaccggtgtccattactataacctttccaagaagacatataggagatggaaccttcgaatattcttgctctcatcatactcatcagtggaattatcggcatcatcattataaaagctgtcggaaatctcctgaaatcgcgggcaaaaagaacagaaagtgtaattgatgacatcattttatcctctatcggaaaaccccttatcctgttccttattatcatcaccgtctattctactctggcaacgagcaccctcatacctcctgaatacacctggattttggacaacagataccttctggtctgtattaccatccttgcaacctggatcttctggtcatttgtaaagaatgttgcaaaccagtacgaagagtacatactccaatcagcgacaaatgaagcaggaatcaggttctatcatttctttcgatcgacattcagttacattgtctggataatcgccggaatcattatccttaagatactcaatgttgatatcacccctcttcttgctgccggaggtattgtgggaattgccgcaggttttgcaggaaaggatatcctgggtaacttcttttcaggggcactccttgctgcggatcaaccgtttcgtatcggtgaccgaatccaggtgcaggactatatcggagatgttattgccatagggcccaggagtacaagaattcagactcttgacagtcagctgataaccattccgaactccatcctcacgaatgatgtggtgatcaattatgccgaaccggatctgaagatcaaggtgcgagtaaatatcggagttgcctatggcagtgatattcaaaaagtaaagacaatacttttcagaatcgcagatgagatcattaaaaccggtctttgcctgggtgatccaaaaccttccgtatttttccttgaatttgcagagtcgagcctgaatctgcagatgattgtatggacagaaaaatacacgatgacgtatgagattcgggattttataaactgtcgtattcagacggaatttgagagagaggggatcgagattccattcccccagatggatgtacatatgaataaatgagaggtaaattcatataccctgtatcattcttaagcacgggagatgaatactgtttatggaactcagccccatggaactttttcagaaagaggccccggaatgtgcagcagcattcaatagtctgattcaggcacttattgcaagagagggattagaccagaagacaaagcagctcatctatatcgccatgaaaacggctatgggcgatgaccgggcagtccgggctcaccttccaatggcaaaagcacttggagcgacaagagaggagatggttgatgcagtccttctgactctaaccgtcagtggtatatcaggtgttttaaaagtccttcctcatattgttgagatgtatgatacaaaatgagcatcggaaaggctgaatatctccgtactcttacggtctcaacgcttcagaacagatcggtaccagtcggtacagaactcgatggaagctcccctccgtccatcttcatcggaagtgccggttacccgagggtctatgccggccctcttatcacccccgaacatggagatacgggtatatatgacacaccggagtcatggatcccggcacagaagtcacaggaggagattatcggataccgacttagtctggtgcggggaaaaagactggttgagaccaccgatatccatagcagatttgtcagccagttgcaggagatcgtactgtcagacacttctgttgagagtgaagctgcatttctcgaagtcccgacaggtttttcattaagtgaggagcatgcacctttcggaccaagtgcatcaatagatacactctcatgtgaaccggtgagatggaaccaccaccttgaacgggtcttttatgacaccgacctgctggcacgggatgctgtgataaacctccatcaggagaaggttccattctctgcaattcaaaaggcattctctgctggaaccatgggaaacggcaagaaacgtcatcttgtcccgaccagatggtctattacggcggtggacagcacccttgccgattctctctataaccgggtgaaacaattcagtcccattgatacctggcgggttcatgaattttcaagccttcataaccggtatgcaatcatccttaccccgaccgggtggcagtatgaatggaccgaggcttttatcagggttcttggagacgagaaactggtattttcagactctgaagtaaagcggccaaagacagaatactcatctgtcggtggttgttattactcatgtaaaatggcggtgcttgaagcactcctaaaagaacaaaaacaggccggagcaatcgttctcagggaggcaaccgaagggtatgtgccactcggagtatttaacgtccgcgaaaatgtcagaaatgcgatgcttaccaggggaaaggagtttgaatcatttaaggatgcattctcctatgtgtcagggaccatgacattggagcctgagtacttcataaaatccggacgtctgctcaggagtcttatgaaagaacagcagactcgtctctctgactttacctcctgcaaaactgagcactctgatggggacaactatgataaatgataagcctcaagaatgtataaagacgtcctgacccaaggtttaaaatcacaagattcggagagaggtcacttcctgatgacggaaaagaagaagatcctgatcatagacgatgaagcagtctttcggaaaatattaaaggaaaacctttcttattgtggatatgtgtgcaagactgcagaatctccgtcagaaggaatgcgatatttaaagactgatacctttgatcttatcctccttgacatcatgatggaaccgcttgatggctgggacacccttgacctgattaaaagtctcacttatggctatgaaaccccggttatcatggtgtcatcaaagaagatggatcttgtcgaggttatcaggtatggggaacggttgtatggatatatggcaaaaccccttacacgggaagagatatgtgccggtgtatactcatttttccgctggtatgaatcgctgcatgaagctgctgaaaaaatcagtaccgattctgtaccaccggaggacattgccctctggcttgatctctcacggcaggtaagagtgattaccgaccttcgggcagaggcagctattatctgtctgccggatttgaaccggaccgaagaagagtgcagggatcagttaaatgcacaggttgatcagatgatccgggaaaaacgctcgaaactggaagaacttgagcaaaaatatccggttttgcacacaataccccagtgaacgggagagaaaaaaagatttagtatcttctgcggtcgccaccatagccaccgctgcttcttccaccgccaccatagccacggttgccaccaaatgaaccacttccgccaaattcacggcgtggctgcattggacgtgcttcatcaatccggagggtccgtccaccaaattcggtctggttcagagaatccattgcgttttgtgcctcttcagaggaactcatctctacaaagccaaagcccttctgctcgataagtttcacattttcaatagtaccgaatggagcgaacagttctctgatctgggtctcgtttgcagagtaggggaggttcccaacgtataatctctttccttccattatcaatcacttttcttttgcatccgtgtaattggcagaaacggatcctgggatcctcgctgccagagacataaccgagaatagcgtgacacaaaacacttcagaccgaaggatgctcagggactatttcagaattgctcgaacgtctgctatacaataattgacgcagaagtatatcaagtatcaccaaaggtacggatttaccggtatccttcccagcaggcttcacaaccgataaatgaatcatcatccggagaggtaatactgatcatcccccctgccttcttcatattattcgtggtattggtatcatgggtgagattgtcaggatcgatcatgacggaaaagacatatcctccgtactcaatcgtgtccggaagtttatattcaagggttattgtctgctcctgtccgcacatgagtgccgggaatgtgctgattaccggaagcagcagataactcccaagatacccacttacatttaccatatcgccggaagtgtcattcataccggtattttttactcccagtgatggatgtatcactcctccccggtatgttgtgctctcataaaccggtacatcaacaaacctcaccagataatcaggaccatcgctggcagaaacagacacagcaggatcatcatgcgtcatagtatcatccgttattatagcatctgccgctccataacctgaaaaaaacaggataagaagtataaaaatgagaaagccggatttttggatcatcatatcatacaggtatatcgttacgggtcaacaaattgccggtacattaatacaggtaatcacaggcatagggcattgaccagtcaaacatctccatataatagggattggttagaaccagaagattcatatcatccgatgccgtcaggttcattacagcaccaggtgccacatagatgatgtcattcctgctcacggcatactcatggcatcccactgatatattccctgagccagtaaggacggttatcagctggtaccttccatctatatagtgatccggaatacctgagccggcatcaattctggcggtcccgagatcataggtaatatcgtacggaccttcacggggatggacaaatcgtgagaaccggaaagtcctgtttgtaccagaatcacccagttccaaggctggaatcatatcctcatagacaacttttgtctgattcaagggttcctgatgattgaagatctcttgtatggttttattctcattagatgaatgtatttcgccagctggtgatgcccagtcaatcactgaaatgaactgaagagtatcatttgcggcattttcaaacctccgaatggtctggggcgggatgtatactgcctggccacgttcggccagaacctcttcatcatcgacgttcagcctgagtgaaccctctgtaatataaatgacctcaggaaccggaaggatagcatcaggtgagagaatacctccgtcctctgatgtgaatacctgcacagacaggtttgatccaagggataaccctcccatccggtcaagaagtgagaccacatcgaatatcgtggtatactcatcatacctgacctcatcccatgcatcactcgtgatcagaatcccttcagagccctcccatgatccatcagcaaagctgataccggaaaatgaggcgataaacagaatatttatgagggttattctgaaaagaactgacattgcagacatactatcaacgttgcccgtaaaatgttatcatgatttttatctcatgctcctgtcagatgaaggggcaggtcgccatcatcacatccaatacagaggatttatcagaaccgactacggtgaaggactctgtcagccccagcaacagaatcaggagaattaccagaagaggtatgagcaccatgacaatcaatatcgagtggagatatgacaatccagaacataccttcagtctttgaataagaatgaataatgaccagataaacccgatgatgccggcaactggaatccagccggggagtaatgccggatttgctgcatacatcagtacagaattccccaggggtcatcttctcatggtatcagaaccaatctctggtgctgactcatgtcagatttcggagccatattatgcagaaaaatcatgcattatgttcaatcttctctctgctccttctactcatggtgtgcatcccaggtggggtgctggcagaaggacctgatgaaataatctctgaacccgaagaaactcagacgccggtaccatccgatccgattcttggtttgatctacaatggcactgttgatgtaaaaagctcaatatcagtagttgctgattccggtatatcatatacgataccagggaacaccccgattggagtgcttgaggtcctgatgaactccggagcaatagaggaactctccattggcgatgaacttatggaaaagaagggtactcttcttctatatggaatcggcaacctctcatcaggaaacgggaatggctggtttgtaaaagtgaacggtgagcgacttgaagatgtcgttcttgctgaaaccatgggtctttcacgatataccctgaaagaaggagatgttgttctgtatactcttggcgatccaaaagggatggtttccgaatcgaaagcatacctgaccgtgacaatcgggatggtggatgaggctgaacctgaaccggtgaaagaaccatcagctgtgaatacgtctgaagaaaatgatgagagtgcggagattactgatattaacaccgatactaaacctcagcaatctgatgacgaagctgaacacgtttcagatgagacccctgaagatcaaaaacctgaaaagaccacgagtggaggtcaggaagtaatatacaccggttctatgtcattaccatccggaaccatcacaattgaaacaaccggcggagattatgacatcaatgctgcaactccgctgggaatattacacgaacttctggaagatgacaagatatccgatctgacggtaagcgataaggcaatgaaaaaggggggtattctgatcctggaaggaataaatgattatcagtttacaggcgacaaaacctggtttgtcctggtgaacaatgtcctcttaaaagactatctctatgatgaagaaggtctgaatatctataaaatcaaggccggagatgaagtcggatactactttggtgaaccttcagagcctgcttctgcagcgcaggttaaactggttattaccatcgaataaatttttataaaaaagtaaatatgaaatatcccatacaataggaacaggcgttcagcagtatgctatacaggattgcatcttttatggcaagataaaatgccagtttcagaggatatatctcacaaaccaccactccggattcaaggagaaatagggggatgtcatgaatgagatacagatagtttatcgccggattggtcacacaattgataagcaggataactacacagattttcagatatgatttcctgatgagaagtgagagaacaagacattcacagataattgtcagaaacagagcatgaataaaaaggggaataagatccatacctgaagagaatcaggaagctgccgggggaaccggttcatcatcacctgacatagggacctgtatcacggtcccatccctgtacccgaataaagcagcatcttttttcacatcaaagctggtttcattcagggctgttatgttcaggacaacagtgacattttcaatctccagatcatcttcaaaaaaggccccttttggcagactgatgtttgccgtaagaaatgggaggcttgcaaggtacgaagaaaccccactatcacgtgtttcatcggtgagcgcatcaccggcatttatatcggcaatggtatcaggatcgatatctgctgatggaatggcatgcaatacaaatccatccagtttatatcctcccccaaatgttccatcctgtatgataaaaggatactcccatccccagattgcactgctggtaaggaagatatagtctttgaactcctcgaaattcgagatagcatactgatagaaataggtggacaccccttcgaccgccacatccgctgatgcggtagagaacagaagaccgataaccaggataaagataatcatccggtacatgattatacaccagatgtatactcagtcgttcaggacatcatccttccggtgaaaaatttataaaagggccgggtgatcaatgaggaagacacgaatccgtttatcagaaatatcagcccgatctcctgccattatgcctgccgatacatatgaattggcactactcttctctccccgctccatgagtgatgcagcctgtttgaaattatcggcaaactgggtcatccggtcaataaaatcatagtagttcagccggacatagtccatcttctttggaaatgtactgccatcattattattccgaatcaggtgacgaaggtcatcaacccgtgaactggtaagagcaggatcttccgcttcccatgcactcagtaccttcttcttaccttcctgaatcagatccagtttcgtaaggacaagatcgcgaaatgccaggttcggatctgcagtcggggtaggcagaggcttttcggttatgactggctgaacttgtgtctccggtaaatcaggctcttttacctggacaggctccggagtctgattcaccatttcttcttccactgctaaagtgggttctgtcgttggtatctctatgacaggtacttcaggtccaaccggagtgacgggagcctgctgaacacacccggccaggagtacccctgcaaacagaacaagaatcatgatggaatatcgtaccatacactgatcttgacgtcatataccaatatggtatcttaatattcgttttcaccaaaacccgtgcggaggagagaactataggatcatgtgggtgacaaccatccatcccctgacaagaggagatcctgggacatttcaaggatattttcaatggaagagtgagaccgaaaatcgaactaatgcccatgaaaacaaaatatgactgtataatggtcttcatgtggcacgcacttctgcccatgacggttaaaacagccattgtcatgatccacctgcgaaaatatgagattcggaatagaccggtaatactcattcaatttttattaatgagccatgtcactctgaaattcgatttaacctgacgatatcatctgtttaatcatgactcaccgatgcagggagttcagggtgatctgattttcttatgaggtcagaacagggaacaatttctccctgaaatttattgaatgatttttatttcacgattacaagaagtaaactttaattgtacaaccgatgaccctttggatcagaggtactcgtgacggatcccccggagcggtgcctcgcgggttcggggccggttacatccgctatagcccatccgcaaggtatacagagctggattccggaaaatatgatccaccggtgatttcaccggtatgccattacaactgttgcaacggatcggtactactggtgccatccggtctgcacacatggatcacctaccagacacatcaaccccaccagacagcactaggtagagtcggaaaaccccccggcattctgtataccatttcatcgggcataatcatcattcacatcccccctgacagcatcccatcagggcacccaccggccccgccccgatattatctaaccatgtttcttttgactttttaccaacactataaaagactcacgtttgggcatcctaaaagataagttattaccttctctcgtaccagtatcaacaagagatatcagggcggtggggattatgggattttggaacagaaaaaaatcagatgctgatgcacaaactacctgttcagaaaaaaagcagattgcaaagaagcctgaaaaaccgatcgtaaaaccagacccggcctgcctacccgtgaaaaaagtaaagatccctctgaataaaacgactagtgaggttaaatttgttcagaattccatcgtttttccctgccccatctgtagtgaattaaataccgtagacctctatgaactggatcccatcctgggaggagagacgatgtgtatgcattgccaggacgtcctgcacataccaggcgggtatcagacccgttcagaggttccaaagttaaaggtatatgccgggcttcccgtggcaatacgaaagttcccgcttttttactggaaccatccggtcattcatgaacttgatgagcagggtattaccaggatcataattcagtacggcctctggggattctgccagcggtgtcatcatcagttcagtccggcagtcctgataaatcttcctcatacatcaggagagatcgtcgattaccggtcactcagttcggaagagatgatggagatgaaatcgctcagggccggaagttgtcccttctgttcacaccggattttactggtcatcatctctgaagtccctcattatgtcatttcggcaagtgagaacctctcccaccggtgggaagaggattaattttctgatgacaaccagtcgtgaattaatccatatgcgatactgtcatgtcccggaaggtgcggcatcgttgatcttgtaaaccatccggcatcttctatctcctttttatcagatataatctcgcctccggcataccgagcggtaaacccgatcatcagggagtctggaaatggccagggttgtgagccaaaatacctgatatcagtaacctctatcccgacctcttccctgacctcccggtgcactgctgcttcaagcgattctccaggttcaacaaaccctgcctgaacactatacatcccgggaggaaaatgaggagaccgggagaggagtatattctctccatcggtaatccggacgatgacggcaggtgaaagccggggaaacacaaccctcccacatgaggagcagacttttgctatctcatcatgtttcatggaggccctgctgccgcaaaacccgcaaaaccgggtgaggagatcaaagcggatcagctgtaccccgcgacaaaaaagaccgggcagattaccagatacatgccctgcgatttcccggagggtatgtgaggtgtagccagggggaacattgtctgcccgtatcccaagagctacccaggcttggtcattataattccccataggtatcctgctgtgaatcttttcctttatttcatcagggatttctgaaaagatgaatccttccgacccctgcagaacctgaccatcagtcctgataagaagacaagagagtgatgataaagaatccccgtgcaggttcatcagggggattacatacgatgggtgaaacatgaaaccagtatctgattgaacctgatttcatatcatatccccctgccttatgagtcttttcatgtatgagaagatactgacacggcgacaaaccgctcaataatccattcattccggacttccggatggaatagcactccataccagggatgtgtggtatgtttcacgacctgggccgtggaaccagaaagagcaagaggaatccattgtgaggtaagggtggcagtatactggtggagagcatatcctgaaaactcctctctttcattcatcaggatatcttgtctccccatttctgtgagataaatgggagtcattccgatctcggtacaagacactatctctcccccggtctctgagagaagcatctgcattccggcgcagatacccaatatggggccggtccacccgttcagaagtgacatcaggtggtgtgatctgtaccagctatcagcaagagcagtcccgcatatgatgatcccagtacaggaagaatggatcgttgccgattcaatcctgacaatacgagtctcatgaccgaaccggtgcacaatacgggatatcggagagacaaattcatcaataagaaccggaaggtccgggtttgtaatatcaagaatcagcatcatgatcagaccagttctgcttgggttatcacgtatcctccggccccatgaagaaaccaggtttctgcatccatgatggtaatcctctttttgaaaaacggagcattacagacaaaactctcatactcccccccctccccggcaagtgagacatggtacttcttgtttatcttcttcattcgctcaagaaaagagagatcaaggggtattccaagccaggtttcatctaggggttcagcaaacaccccggcaataatcacttcaaatccgtctgtaatgagagaggagaggtactgctcctgatcacacagccagagaggggagaagcaccagaggttctccaggtggcagatccgttcgatccgggatgcctggtatactgactggattgctccggtcactataccctcaagaccatactcacgggctccccgctgtatagccaccgtgagatcataaagttccttctcttcgaggccgtccgtctcctgaacaacgagcggaatgccagcagcctctgcctgaagccgggtaagcccgatattgggagtatggaacatgtaactttcgggattgcgtgattgtattgtgataaaacatgagatctcatgtccggtctgaatcatccgccaggcagcgtacagggaatccttccctccggatatcagggcaccgattctcatgccacacgctgcataaggtaaaagacatacccgtacgtaccccggtactcttcaaatatccgtatttcatcttctattattgccaaaacctcttcctgtactggtgagagtgacccatccatgcgaatgcgggcaatattttctttttgcggagcgtaaaaggcatcccatgcagattcaggaagaagaaaagagcctatccagcggtaccccaccttttcgatgcatttctggttatccaaaactgtctgcatggaagggtactcccggtcccagaactccttgacaggagccgggggattttgaatcaaccaggtcatctcggagacaaccaaaaatccaccatttttcagatgatttttccaaagagagaggccgttttcaaatcctatgttatataccgctccttcactccagatcaaatcaacgggagtaggaggcgagtatgattccattccggtacaaacaggagtgatgaggggttcaggattgatcttcttcatcctctgaataagatggtccagaaatatctggtgcagatcaactgcagttatctgacatccggccctggcaagttcaagtgtctgggccccgctcccacatcccatatcaatggttaccggacggggaggaagactggtaagaagaccgaaggtatgccgggtgatccggtcatcgcccgggccctgacggggaagatctgcatataactctaagaaaaacctgaaggcctcttcgttctccatcagatctgagaagttttccattatttccgccgaaatccgattttactattgtccgaacaggccggtgattgccgaccacatattcgcaaaaccgtccccaaggatcacatttggatcaatacccaggatggggaagatgaatatgaaatatgcgaaggttccgatgctcgacccgacatttgcaagtgctgcaacaaggactactttaaagagcggaatggtacgcatctccatgattgattccgcttccatgatctttttgatatcagaaccccgtggttttcgaatctttgcttctgcaatcgctgaaaaccatccggctgcgataaggggatgaagtgatgacagaggactgacaacaaaccccaccagaccggatatcgggtgacctcctgcaagcagagtgaatacgaacgtcagaacaccatgaatcaggacccagtataccagagcctggagaagtacctcggttccgactcctgaaaagacaatggccagaagcagaaggccgaatatggcagttaccacaataccaaagatcagtccccacgggcgggatttcatctgtgaggtaagactgtcgaaaggaggaagagttgccggattttgcaggtactgctcaatccccttccggtgtccggcaccaacaacggctaaaacccgctcatttgctgatcccagcctgataagatggtgagacatgtatgcatcccgctcaccaatcagggccatggcaccacggggagaatatttgtaaaactcctccatggcagcctctactacattctccttcttcagttcctcgatgtcgataagatccccggtcttatcagcaacggctattgatccgataagggcataaaacatcttgaacttttcaaataaggacattgatgcccagaaccggtggagtgtcacccggatgtcccggtcgatgagagcaagttttacctgtctctcttctgcagcgtttatcgcagccttcatctcagcccctggctcaaccccgacatccataccgattctgcgctgtatgtaggctaatatccactgaaccaggagctgggtgaagtttttggcctgaagaatgtcttctatctccgggtttttctgctgctgtttcagggccagatatcgtccctggtcaagctcaattgctaccacatccggctgccattcatcaatcgcctgctgtacttcatcgacactgtgttgcgagacatgtgccgtaccgattatacggatttcacccataatagtcctttattccttctgcatcaatcacaaccggccttcctgccggaatggtttctgactgtattatcattcggattttctcatcctgttcccgttcgtatgcatatcgtctacagagatcaaaggcgataatcactgcatcgggtgtttggaaatcctgatctatcccttcacacgggtagacagaaagcccgttctcatcaagcataaacggataggtgcggcatatccagggtcgggtttcatatatctggcaggttgatccgtcaagaaacctacatctgtccccaatccggcgaagtacccatccaaaggtatagtcgcgatctccttcacaaatccggtcaggatatggctctgcaatctcttcaaatgaaagaccggttgctttcattatccgggtgatctcctcctgcccgaccatgaccagattagaacctggttcagtctcccggcaacaggaaccgcaccgacggcaggaaaaccccgtgccacggatctgttcagcgagtgaaactgaagaggtcatcctttgttctgacccgtgcatatggaaaagaagttctcaaagacccggtggccttcaaaggtatgacttacctccggatgccactggataccaaatatcggcagatgtttatgggcgatggcttcgttgccgcatattgaagaggttgcaagccggtcaaaatcaccaggaagggtgacgacctcatcggcatgggatgcccatacctgcatcgtttgtggatatccctgcagaattccgtcatggtcggtgatggtaacttcaacagctccgtatccgcctttctgtccggactgaaccgtcccgccaaactcctgcgcaatcacatgcaagcccaggcatatgccaagaacaggttttccaagacgaacatattcatgggacaatccggcgcgggagatatcagggcctccgccaaggataattccctgacaaccttcacgaacctcgctgacaggggtggtatttggtatcagttttgcatcgatatcaagatcccgaagagctctcaggataagatgattaaactgaccataattattgaccacatataaagggagcatctgccctatctattagacccttcagtagatatgcattcagggactgtaccctgaaacaaaagagatgatcgagcgggtaatctcctccggactatagccaagcaaggctgcaagcatcattgctccgccacatcccataccttcctttacttcaccgatacaataacggacaagaccggagtgtccaatctcaccaaaaccgggatcaacataggttatcggaactccgatatcctgtgctgttttatcgcaacttgctgcatgatcatccctgacatatacggtcgtgacaacctcggggagagggtttccgagggccttaataatagccgctacggccagcatctgtgtcccgcctgcaagaatcaaagttccgggaaaaccatcagcaagtcctgctgcaacggccatcatcggatcacccgtctcccggatgatatccatgggatctggaattgatctgccaatacgccgggtcactgcagcatatatctcttccttcatcgagtcagggctggtaactgacgcgctactcacctttgcatcatatccaaggcttctgagaacacacagagcggtcgtggtcccaccaggaacacattcaccgacaacaagtagatcatgggctgacagaagtttcccgatacggaccccctctttatacaggcgttctgcatcagggactgcaggaccatcacgtggatccccgcctgcctgcccaagaagatccagaaccggcacagtagggcggtgaacaaggccggcatttataaacaggggggaaaccccaatacggtcaagaacagcccttgttattgaagccggtgtcggacatccggtaggtgtgttcggggtcgcatctgtacttgttatgatcccctgccagatgagttcggcatcaaggaccggtacgagaagagagcccatcggattcggaccggcccctgataatccgggaacggttgaaagcatcgtattagccagtataccgataaataatggcctttttggtgttatcgaatatggacgggagagaaaaaccatcaacatccgttactctgaatccaccatcaatctctcgctccctcccatacgcccatatcagaaggtatccaaacgatctgagtagtcatgtttgaggctatccgtgccctgctccagttcaccaccgtccttccccttggaaaaacagcccccttcgaagcattcgcacataatacctggctctaccccctggcaggatatatcacaggcggaatgggagcgatcataatcctcctgctcccggctccttcactcgttctggcagtaatggcaatcggaatggtgctgctgatatccggtgccaatcacctggacggccttttggatttcggagatgggcttatggcacatggatcccaggagaagaggattcaggcactgacagatcggcagatcggtaccggagctctgactctcgggatgatggtaactctcctggccatcgcctcgctcagttcattccctgatattctgactgctgcatcagcactcatcttcgcagaaacagggggcaaatggagtatggcgatactgacaatattcggaagaccattccatgagggacttcatgcaacccttcatgagagagcaaaaatctggtttgtcatcccggcaacgctgcttctgattcctgcttttctgctccccctctcctgggaggcgaagggagctgctggaattggactgatcctgctcccctttggtatgagatatcttgccgaccggttatttgggggagtcaacggagatgtgaccggtgccaccggagagataagccgctgcgctcttctgacactacttgtcatcacccttttctgacacccctgcgataccccggaaaattacgtctatgactatcagagtcgtgatttgaatcggggagtatatccgtgacctttttcatcatcgcatgccacggcagacccgtcccggaccagactattgaactgcatcgcagcttccatcaggatctcaggcggaactgaaccaccttttatctgagaatacgcaatctcgtaaggagaaggcataacccgcgcccctacctgaatccctttacaattcatgcaatatgagcaccttgtgtgcactggcagttttccagaggcgcattcgacataagcccggtcagaaccttcttccctgataatcggaatagacttcattcgtaatctgatcattcccctgaaaacctattaaccacttcgtttcccacctgataacagaatttcaggcgttcattctctatgagattcatagtgaaaaatattaaaaggacttctatcaaatatgtaatactcgcataaccgggctgtgctttgcagttctgatatcgtgcggaggtattggaggatttgtatatatggcaactgaaaagccccacattaacctcgctgttattggtcacatcgaccatggtaagtcaactaccgtcggcagactgatgtacgaagccggagccgttccggcacacatcattgaacagtacaagaaggaagcagaatcaaagggtaagggttcattcgcttttgcctgggtcatggacaacctgaaggaagagcgtgagcgtggtatcactattgatattgcacacaagcgtttcgacaccgacaagtactactttactgtcgtggactgtccaggacacagagactttgtcaagaacatgatcaccggtgcctcacaggcagacgcagcagtcatcgtcgttgcagcacctgatggtgtcatggaacagaccaaggagcacgtcttcctgtccaagaccctcggtatcaagcagcttatcgttgcagtcaacaagatggatgcagccaactatgatgaagcacgcttcaaccaggtcaagtctgatgtcggtgctctcctgaaaatggtcggaaccaaccctgacaccgtcaagttcatcccgatcagtgcattcgaaggtgacaacatcaccaagaactctgacaagatgccctggtacaaggggaagacgctcttcggactcctcgatgagctcgaagttccggacaagccaaccgaaaagccgcttcgtgtcccgattcaggatgcatactccatctcaggtatcggaactgttccggtcggccgtgttgaaaccggtatcctcaagaaaggtatgaacgttaccttcatgccggcaaacaagtctggagaagtaaagtccattgagatgcatcacgaagaaatcccacaggcagttccaggtgacaacatcgggttcaacgtccgtggtatcggtaaggacgatgtccgccgtggtgacgtctgtggtgcatctgacaacccgccggcagtcgcagaggaattcaccgcacagatcgtcgtgctccagcacccaagtgcaatcaccgtcggatatactccggtcttccactgtcacactgcacagaccgcctgtacattcactgaactcgtcaagaagcttgacccacgtactggtcagacccttgaagagaacccgaccttcctgaaggccggagatgcagcaatcatcaaatgccacccgaccaagccgctctgtcttgaaaacgccaaggaattcccgcagcttggacggtttgcaatccgtgatatgggtcagaccattgctgccggcatgtgtatcaacgttgtcaagaagcagatgcgctgatagaattcggtgttatcatgcagaaggccagaatccgactcaccggaaccgactatcagaaagtagaagaagtgtgcgaaaagattaaagagatcgctgagcggaccggtgtcaatctggccggtcctattccccttcctaccagaaagctggtagtacccatcagaaaaagtccggatggggaagggacagcaacctgggaccgctggcagatgcgggttcataagcgtctcattgatcttgatgctgatgagcgtgctctccgtcagctcatgcgtacccaggtaccaaaggacatcggtattgagattgtccttgaaagctgagacaaatatgggtggcttttcataataagccgcaataatcccaatatcgtccacagtacctcctcaggaggatacctttcttttcctatttattgggcgaacagggaacagatgtaaatatctactggacgcatttttttcatacaaatatacctgttctatggaactgtacggtataccttccgaggcagaataacaatgaatattcaggtattacgggaacgatatgcacaatgttctggtgcacagatcttcgggatcatttttcttgcaggtcttcttctccgggtgatcctgccaaatcttaaattactccatcatgatgaggccatccatgcatggttcagttatgaactcctgaccaaaggagtatatcagtatgatcccatgtatcatgggccatttctctattacatcactgcagcgttgttcaggatcttcggagattctgatctgcttgtaagactactcccggcagtgtttgggtcggccataatattcctcatatacgggatatacaaaaccggctggctctcgaaaaatcatgcgatctgggcagcactgttttttgctttttcgccggatatggtatatttttctcgatttctgcgtcatgatatcttccagttattcttcaccgttctgctgctccttgcaatcctcgcatatatcgaatttaaaaaaccgggatgggcatttctggcaggatttgctgcagcatgtggtatgtgtctgaaagaggacatgccggtagccatactaatatttggagtctttttcatcgctctcctctatttccgtcgtatacaccttccggatacctggaaacgggatctcattggtacggttctcatagcggcgggtataggatttgtcttctatacctcattcttcaaccatccggagatgttctttgaggcaccattcaaggctattgaacactggacatccatgcatgaccagtgcaggctgtgtggtccgccatactggtacctcatcatgctcattctctatgaaatccctctgcttatcctggctatatacggcatctggcactggggatggaaagacaagggactgagtctgttaagaaatgtggatcctaaaaatcaaggactttctgacgaaaaaacttcactcctgatgatccttctcatcatatggaccggatgtacgctggttttttatgggtgggtaggagagaaagttccctggcttttgattcatcagttatttccgctcatatttctcgcatcctacaagatagaagggaaaaaagtaatcgccggaattatcacccttctcttcctggtgggaatgacgatgcatgtctgcttcacacctgttgatatcaacgaacccatcgttcaggttcagaactctgaggacatgcgtgacgtcatggcattgatcgacactgcaaagactgtagttgtggcatccgactcctactggccgcttccctggtactaccggggtggaagatgggacaagatcctgttttatggcaaaaaggttgatccgatgatgtggagtgggaaggaaccggatcttatcatcacccatgataccgacagttatgcatccctgcccggatatgaaaagagagcgtatcacctaagctactggttttccttgtatgacaaccagcaccgggctctggagtggtacttcctccgggatggaaagatgggaacggtgaatcttgacgtatttgtcaaggtaaataatactgacctaaattaatctacttcagccttttttgtcgttcatcgtctgcttaccagcacatattcacgctggtcattcagtagggatatccccctggcatatgccatttcattggacttgcgggaaatgagcgatactacagcacacattctgatgttggagagaaattttatccctccaaaaaaatttaggagggttacagttattgttaagtccaataaaagatacgatccgggtcaatcaattcaaattataagacaaaaaagataattaaaagagctcatcgtactgatgagcagttgacttcttctttggtttatcacgggagccgaaactgccaccgccgccctttccgccacctttgccgccacggttcttcatgattcggaaaagagcaaacccaacaattgcaacaacaatgattccgataatataggggattatcccagacaggtcagggaattggaatcccttgggagcggcctcaagttctgcattcaaatcctgagttgccgtgaatacttcatctgccttctgatatgcttcttcagcttttttcctggcttcagtgtatttaccggcatcatagagctcttttgcatcactcgcgtcttctgcagcaaactcacgcttggttataataggagcaagccgtggatcacttccgagttctttttcggtcttgaagtaattgatccactcgtcagtcttgtctatggcttcttttgcatctttaattgctttctgggacagacccatgtcaagcatcgcataggcatccttgatgtaggtatttgcattcttgatatagatctgggcatttgaataacttgcaccggctgctgaattcagtgaggttaatgcctcctttgcctttgcttcagccttggaaacatctatcccatcagctttgttctgggcaatatccttctcaagttttgagtaggcatcttttacagttgaaatgtcgcccttcagctccccaggattcgtaacaaatgctgtgacattctttacggtctctttcacccggcctccgggggttgccacgttcaccgaaacaatctctatttctttggaactgtcaacctttggtgccattcctttcagattgactttgacactttcatcgacgttctcataggagagttcccatccggaaagatcaagttgtttcttactgaccgcaggtctgggattttccacaccatcaagaatgatggagtatgtccagaccggattttcaagttcggtttttaaggatatactctcatcactgggaaaggtcgtgccccctatcgagacaaaactcagctggagatctgcagaaacattcgatttaccggattcaagatctccggaaggctttacattcacatgaccgacttcaacactggccattgccggaatagcaatgaaacaaaaaatgatacttaaaaagatgattaatgatccagtcttcataactccctcactcaaagagtggttcaatactctcatccagtttcaaaacattctcttcatcaattctttctgacgtggctttcgtctcctttgcaatctcgagcagattcgtgacacgtggagcatctgcaatggatgctaaaagaacgacagctgcaacatacctgctctgggccggataatctccgcctcgcacctccacaccggcgatattctcctcaacccagcttttggctttttcaatccctttccggtcaagatcatcaggcggtccggcaaccagaacaagagcacgacttgtggtggtatattcacagggcaacgtaagccgcccaagcatcgcccgtctgaccagagacaaaatccgtgaggtcttatcctcaccaagcagtttatcctcaggacgtcgttcttctatctgttttcttccgatgatccgatcaaagaaactccggtccttttcaaccggagcagaattgataacttcactgatggcatatccgacagaactgatacctccaccccgaagggtattgataatctcgctggaatcgacgaccatctcaccgatacccagctgacctatctcacctgcacggaacaataacccaaacctgcggactatctcatcattcaaccggtcaaatgcgcccttgatactctcgccttcatttttccaggcgctgttgtcaaaaagaataacattatctgcttcttttaccagagttgcaagacttcgtgcagcattataggaatataaccgtccttcttccggagcggggagaatccccagaacatagaccggctctttataaatctttttcagatgccgtgcaagcacaggcgaaccgcctgaacctgttccgccaccaagtcctgatacgatgatgaatgcttcagtatcgccaatacctttgcggtcaatagcattcatgatgatatcaatctcgtcaaaagtaatctgggcaccggtatcattatcggtccccacgccatgacctttgacgctcgtctgaccgatcaggacacgatcctcaaaattgaggtgttgtaatcccatcagatcagttctggctgtatttaccgcaatagcacgaaaactgctgccattggttctattgtcaaactcaatgaaccggtcaacaattttgccaccagcctgaccaaatcctataaaaaacactttcatggaggtacaccagttgtatgaaatatcggaattctgattatttggtacatctttcctttatacattcaaaaagcttcttcaatgagcaggatgggaatatctaagggattataacagaatatgcggatagcaataataggaggaggcatatccggacttgtttcggcatacaggctttctaaagaccataaaattacaatttacgaaaagtcagcagagataggggggctgctctcatcataccaccggaaggcatattccattgagcggtactatcaccatttcttctcaggagatcgggcatttttacaccttttagatgaattgaacctatctgatacgatactctggctcaaagggtcaaccggtacataccaaaacgggaccatctatcccctcaccacccccctcgaaatactgctctatcctcaccttagcatatttgaaaaattcaggctcgcattattcaccaaaaaagtcaaacactttgatctgtcacaccttgacaccataagcgcagagaaattccttacagagcagcttggagagaaaatttaccgctcattcttcaggccactcctgaattcaaaatttggtcagaatgcagagaaaatctctgccgcatggcttgtcagccgggtggccatccgttcggacagaagtcttgggggagagcggctcggatatcttgagcgggggttttcatccttcatcgaaagtctttcaaatacgataaccggatatggaggagagataagaataaacacaccggttaccagcatacaaaaagccgggggggaatggtatataaatgatgaaccattcgatgccgtcattgcaaccatcgcacccggtcttctgaaaaaaaccggtcttgatattccggatatcccctaccagggagcggcctgtctgaccatggggcttgtccgtcctgtcactcagggtatttactggattaatctgtatgatgatgccccctatggagctgtcatcggacatacctgttttgccccaagagcatggtatggtgaggatatcgtctatcttgcatcatattacaccggcacgccgcccaccgacctgaaggaacggatgatagaagatttccagagaaaattttcagtcaggagtgatgagatactatgggcagaaatgactagagacccctatgccgggccgctgtatcttgccgggtataaagagcagatgaacatgatatcagttcccggacttgttcttgccggtatgttttctgaagagaactatccggagcggagtattgagggatcggttcgtgccggactcagggctgcagaagagatcgtcaggatggaaaagaatccggaagtgacctgagtgacaatatcaaatccggtaacagttgtcattccggtgtacaacgatgttcatgccctaaaagaggcggtaccacgagttctgcagacgctatcctgcattgctacagagtttgaactcatcatagccgaggatgccagcaccgatggatctgctgaattagcagcaaagtttgcccgggagagcccacaggtcatccaccttcaccgggatgagcggctggggaggggatcggccctgtctcgtgctgcctcaatagcccgtggagatatcttctgttattttgatgttgatatggcaaccgacatctcccatcttgaagaactccttggccgaattactgaagggtatgatctggcaaccggttcacggcttcttccggagagcagaatcatcagaagttgcagccgtgagattaaaagcaggggatataacttcctggtccggcttattctgaaaagcaccctctctgatcatcagtgcggatttaaggcattcagaaccgaagtgctcagggaccttctgcaggagacgtgtgatacccactggttctgggataccgagatccttgtacgtgcccagcataaagggcttcgtatcgcagagatcccggtaatctggacagagggacaggggacgacagtcagatcaggtgatatctggaagatgggacgagcaattctccgactctggtggcagctccatgtatcgtaaactctgtgctatcatcttctctgttcttctggcagtaggaatcctggccgtcatggtcatcagagtctggaatgacctggccgatgcacttgcttatgtaagaccgctctatcttatcccggcatgtcttatctgcctgtgtgcctggtttgtcaggggagggcggtaccagtccatcctctcgcggatgcatgtatccatttcactcatcttttcaacggcctgtatctacatatcacaaacggtaaaccttatcgtcccagcccggcttggagacctgatccgggtggtcctgctcaagcatgattatgatgcaaccatctcccagggtctctcctccatcatcgtggagcgggtttttgatatcatatcggtagcagtcctgggcctttgcgcagtggtctttgtgctgaacgccccgtcctgggttctcatgctgctcgttcttccgctcgtgcttgggggaatcttctttctggttctcatcctcacgggcaaagttcagactgacaataaatacatcgggtatgttctgacgatgatgaatgagatgcggaatgcatccctgactccccgatccgcatgtgttctcgcagttacatcacttggtatctggatacttgatactgccatctgttcccttgttgcccttatgttcgggcaggatatccctttttcaatcgtcctgcttgcagtagttgcaggaaaccttgtaaaagcagtccccctcacacccggcggagtcgggacctatgaatttgcccttgccgtcatctttgaactggcagggacaagtccggcagtatccacccttatcgcagtcatcgaccacctgattaagaatggtatcacccttatcggaggggcgatctctatcatgtacttaggagactgggtaatccccgaactctctgaaagtattaagaaaagactgaaggatgaatcataaggcatgattgaatcaggacagattattgcggtattatcctggctcttccttcttttcctattccatctctctctctatcccttgataaaagaatacctgcccaaaattgcggtccccgtatcctggactgcgggatttatcctgaccgctcttgcaacctggtatgcagtcttttgtggtcttcctccctatactggtctgatcccgatcattgttgcatatctctgcaccggaatatttcataagacgggacattacaaagccatcccctcagaatggcgctactacctgctctttttcggcgtgtttcttgccatgctcgtcgtcagggcatacaatcctgatatcaacggggcggagaaattcatggaccatggatttcttgcatcgattctcagaacgcccctggttccccctcttgacccctggtttgccggagggtttctgaatgtatactactattttggtcactggatcatagcaacaccggcgatgctcaccgggatcccctcaaacatcctctttagccttgctctccccacaatcgccgcactttctgccgtcaatctctacggagtgggacacctgaccctacggcgtaccagattactcccggtactggcattttttgtcgtaaatccgtacttcatctaccttggccttaccggaaccagggcctttacccttctctgggatagcagcagagtcattcaggacactatcaacgaatatccactcttctcatttctgtttggtgatgtccatgcccatgtccttggtatcatggcccagtcatttctggttctcatggtaaccgctgcgttggtatgctggagagatggaaccagggcacgtatcttaattcttctcctgactgcactcgggctttcggtaattccggtagtcaacagttgggatgtcctgatttgggcaccgatgattctggtaacaggcttttgtctgattggacgtgaatatagaggggcaccagcccttacaattcaggttgttatgcacactgtgcagacaatgatccgggagcgggggggacaatggttccaaaaacccgtgattgctgcaggattttatctcctccttgttccggccctgagtctggccctcatcagtccgctcctccttgggatgcatacccagggaattgcagggattgggtttgtccataccccgactgatatctggcagtttatcatggtccatggctggttctttgctgcctttttattctctttcaggtcagaactcagaaaagtcccttggatccttcttgctatcttcccgttctttctgaccgggtacctctccgctgcacttgcaaccctgatcctgatttttgtcatcaggcgaagatcaggatctgcagatcttctggctgcaggaggacttacaattctgctcttttgtgaacttatctacctggcagataacatgggagaggtctattaccggatgaacacggtattcaaactctatatcggtgcctggctcctctgcggaactgctgcggccctgatgattggaaacgagctggatgcatatatcaccagaaaaccagggcggacttcacgggtcatcagtgtatctatcataatcctgctctgtctctgcctgattgtccccccggtcatcgtctcaaccattcacggaccacatacccctaccctggatggcatggcatggctttcacaatctcatagggaggatgctgaagctcttgcatttttacgaacactccccggtgagcatattatcgtggaagcagccggggatgactaccagtatacctcacgggtctcatcattcaccggaatcccgacgatcatcggatggcagttccatgaatatatgtggagggggaattatccggaaggctggtatggtgagcggggcaatcatatcaggaccatatatgaaaacccggaccagaccatccccctcatggaacggtaccgggcagatctgctctatgtcggccctgaagagcaacaaaaatatactatttcgatacctgcccatgaccttcaggaactctaccggaatcgcgatgtcgtgatctaccagcatcaggcttgatgaaacccggccagtcggggagatatttcccttggaaacaaaaccagatctacgaacctttaaacgcccacaatcgtaactaatatggcacattcgtcatctgctgatgagtgatgacggagggtcatgcccctcctgaatgaggtgaattcatggcaaactacgttacctttgaagtctctgaagagatccagaacaaggctcttgaagccgtcgaagccgcacgtgaaagcggaaaaatcaaaaagggctccaacgaagccaccaaggccatcgagcgcgggatcgcacagctggtccttattggcggagatgttgaaccagcagagatcgtcatgcatcttggaccactctgcgaagaaaagaagattccgtatctcttcatcagcaagcagaatgatatcggcgctgcttgcggactggaagtcggctctgctgctgcagctatcgtaaagtccggaaaagcaaaagagaccatcgatgaaattgctgcccagatagcagctctcaaagctgagtgaataccatggacggaacgcccgctgaagtaatcgaggttatcgggtcaaccggtatgcatggagaagccatgcaggtgaaagcccgtatccttgatggcccgaacaaggggcggattatcacccgtaacacggtaggaccgatccgtgaaggtgatgttctgatgctccttgagactgaacgtgaagcaaagaaactttcccggaggtaagaacaatgattgatacgcatatctgttctttctgcggcctgcagatggagcctggaaccgggaagatgtacgtcaaaaaggacggacagattttctattattgcagcaccaagtgccagaagaaccataagctcggacgtattccacgccgtgtcagatggaccaccgctggccggaaagctcttggcaaggtataacaatggaacggacatttctgatggtaaagccagacggagttcagcgcggactgatcggtgaggttatcacccggtttgaacgccgcggattcaagatggttgcctcacgatttgaaaaacttcctgatgcacgggtcatggagcattatgctgaacacgtgcagaaacccttcttcccaggtctgaaggcatacatcacgtccggaccgtgtttccttatggtatgggaaggaaaagatatcgtaaagataagcagggatatgatcggagcaaccaatccggccggtgctgcaccaggtacgattcgtggagactatgcccttgagatagggatgaatgtcatccatggctctgattctgttgaaactgcaaatcgcgagattgctattcatttcaaaccggaagaacttgtttcatatacccggatagatgaacagtacctctacgaataatttttttttggttttaccatcttttttccattccggttcattgaacagatgtttcaatacaaaagaagtaaaatagtatctgactggtgacctggaatgaactcagaaaaccggacgatcagaatcacttcactctgtatccttgtatctcttctgattgccgtcgttctgatatccggatgcacagagactgaccgcctttcagacgaagcaaagaccgcgtataattctggaaggtatgccgaggcagtatcactctataaccaggccatcgaattgtcaggaagcaatagtcagctctactacctgaaagggcaggccctttttgaactagtcagatataaagacgcaatagatgcgtttacggcagcaatacgaatacaaccggattatcctgaggcatggttcatgaaaggcagggccagttatatgatgggtgattatgatgaggctgtcaggtcattctataaggcaatcgaacttgatgagaccaacaccgagtactggtatcatcggggccttgctctgtcaggccggggacaatatgatcttgccatctctcattttgataagatacttcagatgaacccatcgctggagaaggcctggagctcacgcgggtatgcctatgttatggaaaagaactataatgatgcgctggattcatttgaggaagcattgaagataaatccaggcaatgcagagaactggataaacaaggcatcagtcctgcgggttttgggaagaactgatgaggctgatatcgccataagtcaggcaaatcttctctataaaaagcagggagaggttattgcccgtaaaatcccaaaaactcctataacagttattccctgacccggcaggaagacatttcatatttctctgacaacctttagagagaattgtgcattcaggcacctggaatgtgtatcttcatgaagttcgtttcaactgttgtattggccctgtctgtgctgatgcttattctcctgtgcggatgtctgggaactgagggatggagtgcacaggactggatagagcagggaaaccggtttgcaaaagacggactctatacagaggcagtggatgcatatagtcattcaatccggcttgacccgataaacccaaaggtatggacctaccgtggcattgcacttcagcatcttggtcggcagcaggaggctatgaatgacttcgatgaggcaatcaggcttaatcctgatgagagtggcgcctggcaggggaaagcatcctcatatatagagagtggtcagtataaacttgccataaaatctgcagagcggtcactggaactggcaggaccccaggataaaaaggagaactcatggctgctgattggatttgcatacaaccggcttgaacagtatgaagaggccttgcagaggtttgacaaggctatcgagatagatccaaaacgggtggatctctggcagcataaggcttacaccctgacaaagttaggcaggtacatggaagtcctgaaatgctatgaggttatgactggattagaaccagacagcccggaactctggaataaaaaaggagaaattcacctggccctcggtcagatcaatgaagcaaatgaagctttcgcaatggcaaaaagcctgattgaaagaaattaaaatttattttctatttatactctccaaagagcatgagcagatctctgatatgggagtcacattccctgatgaggggctcttgtgacggagtaacccctgctgtctttagcatggatacctgagtctcaagagcatgaagatggccgataatcttggacctgataatatcatgttcggccgggggctggacctcctttttctttcgtactgattcacggatcttatatgcaagttcagtgaactgagcacgcggatccccgcctttctgaatgtaataatcagctccggcattgagggcctcgataaccacatcctccctgcctcttccggtaaagatgataaaggggatatgatttcctttttcccgaattgccttgagaaaacccagcccgttcataaccggcatctcataatcagagaccacggcatcaaagccccgctcattcagcaatgcaagcccttcctcggcggaaagcacagtggttacggaaaactccccatgcctttccagaaaagcacgggcaatatccagaatgacgggttcatcatcaacaagcaggacggatatcataaatagagacttattgccattcaaggactttaatcatggcgatgcaggatcaaaaaaggggcggtacaggtctgcccttgccctatgcattaaaaaagtgaagatatgcaaatgctacaagaattaccacaatcagcaccgcactgataacatcaccaaaaccaaagaccagtttatgaagggggagattttttcgggcccgatacccccgcatatcaagagtaagaccaaggacctgagtttttgcaagtgaatttgcaacgagtggtatcataatcggtttcatgcttctgatctttccggatataccagttcccgggttataaccccggcagagctgtgcttcatggatccgcctggcctccagctgaagacttggaataaaccggagcgctattaggagcatgagaacataatcgaccggaaggcggaatgccaaaagtccggtcaccagatcactgggttttgtagtcacgacaaagagttgaaatgccgttatcatcacgataaaccggagggagaggataataccaaagagaagtcccccaagagtgatcccatatccctgacctccgggttcaccagactgaagaatggtgagtaacaagtcaccttcctggaccgtcagactggtgagtatcacgaggaagaatgacaacaggataaggaacggtacctgattgattatctctttgataagaccagaaaaaagggcaccaagcaccagaacaccaatgagaaaacagagaaacggcacctgggccgacattacacataacccgacgataagaattaccaggagcagcttggtgaccggattcagatgatgaagcgggctgttacccggtatatactgcagaatctcactcatgatgcacgccccttcaggttatgataatccccgatgaccctgccgttctccatcgcaatgatccggctggcatactcttcggcaatccgcatattatgcgtaaccatgatgatggtatgcccgctcttctgcaaagtcagcatgagatccatcatccggtcagactctttctcgtcaagtccggtggtcggttcatccagaatgataagtccgggtttcatggcaagaatacaggcaaccgcaagccgctgccgttccccccgtgaaaggtgccggggataggttgcttcagagcccgatagcccgaccatggcaagcacacctccaatgacctgatcaggggagtctgctccgatattttcaaggccaaacatgatctcatctctgacactgtcagcaaagagcatggtatctgggttctgaaacacaagaccggtctgcttgacaagatcgatgaccggtgccgtagctgcatccaggctccgcacatgcactgatccctcgtcaggtcgtaacagaccgttcaaatgcttcaccagagtcgtcttccctgaaccattctcaccaaggattgcaataaactcaccttcatagagggtcagtgagacgccactgagcgcttctattgtgccatatcgtttgatcagggaatcaatggttgcgataaccggacgattcaccggagaatatggctcaagatcaggatcggtatagagggctttcatcgagccctgctgctcagggaagatctcattaaatgtcccttccctgctgatatgaccctcttccatgacgataacccggtctgcaacattccggtatccttcaagggaatgatccacgatgatgatggtcttccccctggccttcagatcctgcaggatctcaataattcgggatgttgccactacatccagctctgaggtcggctcgtccaggatgatgatatcagtatccatcgcaagggctgcggcaatggcaacccgttgtttctgaccgccggagagggcatagggtggacgttcacgaagatgggtgataccacagagttccatgacatctctgacccgatcctctatctcctgtttcgaatcgatccttgtctcaaggcctgatgccagttcttcctcaacactggtgaagatgagctgggagtctgcatcatcaaagaccatgctgacataccggttcagttcaccgacacctgcatactcagtcaccggcctgccgttcagagcaagatacccggaacaggttccgccaaactcatgctgaaggatgccggacagggcataacaaagcgttgtctttccggctgcagtcggaccggtcaccaggacaagttctccggctccgatagaaagagtgatgtcccggagggccgggcggactcccaccgggtacgtgtaactgagcgctgttgcgagtatcatgatctccgggataatgcccgtgatgcaggaacatacagaatctgtgcgataatggtgttgataattgcagtcggtatgactatcataaccatcatggcactaaagaaggcatacaggctttcatagttgaatgccttgaacagcagaccaggtgcgaccatcaccagcagcataaccacacagaggaaggagatcccgcttgcaaaggttgcgaccagagttgcaacggatggtgctgcagcaaaccggtttttgagtgcctggaagacgagcagacaggcaacggctccgattggctcactgataagatttcctggcgggaatatcgagtgactgataagagcactgatgatgccaccaataaacccaatcccaagagcctgggagaatttcgggacaaccagcatgatagccagacagtagaaaacgatgacaaagttcggtacaaggaatggcggtaatggtgcgtataaggcggcaaaccgtgcaattgcaccgaccgcaagtaaaatgccgacaatggcaatatcctgtgatttcatagtatcaattatcgtgaatgtatatcagaatttattcagaaaagcaataccgtaaacatgagaatttggtgtcatcgccaagagcggggcgaacccggacatgcaccccgacgacgatgatggacatattgagtcatctatgtatgaaattatacatcgacctataagaaggttatccagtatcccacacgtctcatgcccttatggccatccaaaacccagatagtcctcgcggcgcacggttaccggaacaaacgttccctggaaccagacattcactaccacaggtgcaccctttcgaaactcctgtatccggcggtcataccctgccctgatatgccgggtattcttctgctcgaagagagcccggactgccctgtaaaacccgatcatctgtgccagataggccttctcataggcgatggtctccctggcaaaagtcagagcatcatcctctgatatcggacaatggtactcaccatgctcattcagaccgctgatttgtctgaactccaggttcttccttcggtctggttcccggtgaagcatatacggataaatcctgcagatagtaaagcgctcatcatatatcctgcaccgggtatcagtgagaaagatacaggacccgtcttcccgtaccctgagggcatagccggatacgtaaaaattcccttcttcatcggccagctcaaattcaggtgccggtatcaggagggagggattcatggccatgacccgctctgcatcggcatccagtaaaaatacatgacagttaaattccgtcgtacagcatctgccacacaaaagacaggaaaatccaacatcgctgataatgtctgccagatcctgctcatgccatttcagaagaagatcctgctcgaccatgagaccggagagttcccgatcgatataggaatcagacatttctcagtactcagccattctgatgcatagtagtgacgatgaccaatcacctttgtacccttggcgaatctataagagccagattcactaatcagaaattacatgcttgaagcctttgaccttgccggaaggataccaaagggacaatactcatcgatcgtcgaacccctggaagcacggactgcagaactgcagcgggaagtaagaaaacgggggaaatcggtcatcatagtgatggaggggtggcggggatcaggaattacgcggataatcaacctgttacagccggtccttgacccccgtggaacccgtattcacccaatcgccgaaccgaatgacatcgaacgtgatcatgatatgttctggcggttctggtcacggcttccgtcatatggtcagaccgccatctttgaccggtcctggtatacctcaaccatcgtcgagcggtatgaatctgaccggatggatgagatccccggatcatgtattgaagatatcaataattttgaagcccagattatcagtgatggaaatctcattctgaaatttttcctccatatcagtaaggaagagcagaaaaggcgtcttaatgtcattaaagacagtcccttcaccatgcaggccagatatcttcgcagaaaagaaggcatctacgttttaaatcgtgactttttcatgattgaccggatgctgatgaagacagacatgccggcatcaccctggaccatagttgaagcagagtcgatgaagtatgggtatgtaagagttttgcagacctttaattcggcagtggaatgctggctaactgaaaaagaaggaggaaagaaagagctgggtcagacctaccttattaaaacgatggcagagaccgaagaatcgtcgattctgaaaaaaactgatctgacaaagagctatactcgtcctgagtataaaccgatccttcagaatcttcaggaagaactgcgtaatcttcaggttgagatatataatcacaaaattccggttgctattgtgttcgagggatgggatgctgcaggaaaaggaggctgcattatccggcttgcagagtcatttaatcccaggggatatattgtagagcccatcggtcccccaaatgactgggaaaagatgcatcattacctgtggaggttttatacacggttcccaaggaaaggtcatatcaccatctttgatcggagctggtacggccgggtactggtggagcgggttgagggattctgttctgagtccgaatggcagcgggcataccatgaaataaatgtcatggaggatgaacttaccagagaaggaactatcctcataaaattctggctgcatattgacaaagatgaacaactcaggcgatttgaggaacgtcagaataccccggagaaaaactggaaaataactgaagaagactggagaaaccgggaaaaatgggaccagtatgaacgtgcagtaaatgccatgatccgtcggacaacaaccatacaggccccttggacgataattcctgcaaacaataagtattatgcacgaatagcagttctggaaaccgtccgatcggctatgcagaaacgattaaaagagatgaaataatatccggcctctttaagaaccggaaaataatttatttttaagttcttcacaccgggccttatgggtttcaaaccggtggacgaattcatgcaattccggaatctcaagatcagtctcaatagtcccgtcccgctgaatcgggtatattcttcccagaatctcaataaggcgctgctctacctgcacccgttttaagagttccccatactcgtcaacatctgcaggactaccgccattctgcagggcacgctccttttcacgatttatctcggcattccttgctccgactccgtcgatcgatctgataaggtctggaaggcgtacaggttttataaggtaatcatcaatctggtcaccataccggaggacatcctttattgtcaggcttttcccggtctgcataataatcggaacagtccgtgcctgctcatgttccttgatatgcagaagggtctcccacccgtccatcggcttcatcatgacatcgaggatgatgatatcaggcacatcctcatagaccatagtaatggcttcctgcccactcagtgcaccacgggcatcaaacccctgttgctttaaggtttcgacaaaggccatcttgaggagggcttcgtcatcaacatacaggactttcagtcttttccccacaatcgttcaccacccctgggacctgatacggttcaccgcaccccggtattattgtagacagtattgtccgcgatcatgatatcagttttttctcatcaacatcggtgagtcccacaccctgatcagggttgacatcctccttcatgatggcacgggtctcatcctcaatggacttgacaacttccatgatccgctctgcagtgggaatatctcccagaagactctcgtctagcggaacatcatacacctccttgtcatccatggattcagtcgcacccagatacttcgctccctgcttaatgagacttgatatctcgaaggggaagatgatcttggttgcctggccgtttgccatcgtttttaatgcatcaaaggaaaggaccgtaattgcacgcttatcaagagacctggacccgagtgccagtatccgcagaccctgtgactctccctgtgcacgcaggatctgtgacagccgttctccttcagctttcaggatcttactctgccgttctccttcagcctccaggatcatactcttcttcagaccttcagccttcaggatagcagagcgtttttctccatccgcacgaagaattgcagctctccgctcccgttctgctgcggtctgttcagtcatggcctgtttgaccgtcccaaccggatcaacttccttgatctcaacacgttcaactttcacaccccactgatcagtctcacggtcaagaatgtcacgaagtctcgtattgatgctttcacggttgtagagcacttcatcaagctccatgtcaccaataatgccacgaagacttgtctgtgcaagggcaacggttgccatccggtaatttgaaacctcaaagaaagctttctcaggatcaaccacacggatgtatacaattgcgtcaacatttgtcggggagttatccttcgtaatcacctcctggcttggaacatccatcaccagagttctgagatccagcttgacgacctgggtgatgagcgggataacccaccggaaaccagggttcatcctcccgatatatctccccagacggatctgcaggccctgctcatatggctggacaataatcacaccgcgggcaaagatgatcagaattacaattaccagaaacagggttacaagagtttcaaaaactgccatttattcctcctccacaacaatatgcacaccctgcgaagcaataactttcacttttgccccttcagggatgatgccggactttgatttcgcactaaatatctgaccttcaacagatacttttccagacagggtttcttcatccgcaggatttaataccctgccggttcttcctaccagtgaatccatactgatagtcaggggtttttcatcccccggggtcagacggctgtacagatataccgtcactatggctgccagaagggcgatacctatgcccaatacaataccatacgtggatgagaagatatctaccccgagtatcaccagcacgccgataatgagcaggaccgttcccgggaccaggagaaaaaaacccggcgagaagacctcaaggacaaagaacaatgcaccaaagaggacgatgatccatccatatgagaaatcttcaaaaaccatatggtattcttgtcaggatggaagaaaaagttgtgtatatgtgatttaagactggaatctcaatttctcaggagagccagtttatcccctcgtttcactccgagctcttcagcaatcggatcacatttcgctgccaggagatacgcaacgggaggaagaccctgctcttcccgaaggctttcgtaatttgccatgccctttgatatgataagcgaacaccggtcaagcgcgagcaggagttcatctgacatcagatcaaaccgaatcccgtgttcaacccctgcaccagttgtaagcaaccgggcaaccttcttgtccagacccagacggatggcatcttccatggttgcatcattgagaatcggcttgtccctaacgaccaacgttatgcggctgccatgtgcagtaagccaggagattagagcctggtcaaagacaatctccccgcaattatccgtaaaatagacaatatcactgcagagcgggaatatccgatcagtatcatcaaccacaaggccctttgtaaattcctcatcaaagtatgatacaaaatcgctcctgacttcgtgatccttcaccccgtaatcaaacatgttgccgattacgctggcaataacatgctcccgaaaaccgataagacgcccggatacagcctgtaatatctgaattgaaacttcttcggatgcctgcttgagcgcataaaaagggtcatcgttattcaaccgctgatagataacacgatgcagagcagacgcaaccatcggatgggtccagggagttttgtgcaaaaaccggataatctcctctgcgtgctcaggaatatcagaatatttctttttatcaacatttgccagttcaatctccagatcaactctggataaaaggcagtcataacaacgtgggtcatgtatcatatcattacccgaaaaacaaaatggggccatcgagattcgaactcgagtcagaagacccccagtctcctaggatgccaggctaccctatggccccgttccatactattttctcagctgtcccatatgtacttaaccatagtattctacactccaacaggcaggagcaggattccaagggggaaagatcgctggtacgcatacgccctatgggagttgtatcatgtcaccgctgatatcctcataaggcaaaacaacaaaccattaaataatatagctctgtgactatatcgtattatcagcaggtagcgggagccgggtatgctaaaagagaagattgcaggaataattgagagtatcaggttgattgaaggggtcagattatgtgcactcgtatcccgtgacggtattatgcttggccggtactctgccggcgactttaatgaagcatggtttgctgcgatgtgtgcaacgctcctcgcctctgcagagtcagcagccgtcatcgtgaaagtccagtctcctgatatggtgaccatccattcttctgacgggatactcatcattataggagccggagaaaagatactgttagcagcgctggtagaccctgcctgggacctgaaacatatgaccggaatgctccgggagattgcggaagacgtgggaggaacgttctgatgtcaacaatactggtgatcgatgacagcccgtttatcgtcgatatttttgtaaccatgctggaaagagggggctatacagtatactcggcaaatagcggccctgaaggaattgatctgttaaaaaccgtaacacctgacctgattctgcttgatattatgatggaacccatggacggatgggagacccttgtcgccatcaagcagaactttgcaacaaaagacattccggtcatgatgctgacggcaaaacagctgactccacaggaggcacaggagtatggaatgtatatcgaggactatatcttaaaaccggtcacgcattccgaactctacgctgcaattgaaggggtcatcaaccggaggaagcagatagccgaagatatgaccagggcaaaagaaggtgggtttgaggatgctctcatcaatgaatatgggaggcttgtgaagagtaccgagatcaccaaacggctcctgaaacttctctcatcaacctatgacctctcagacccgtcgatgaagttctctgatgatatcaatatcgccataaaaagtatggaaaccaatatgaaatttcaggagcagcgcctgatccagatccgcgagatattttcaggagctgcctgacactctcttcttcaccccacttcttcctgacatctcccacactatgaagtaagaatacaagctaacctcttcttctatgtttgatctcgtgtgcatcggttgtggtgcaacataccagtctgatgccgttatatacacctgcaaaaagtgcggacaccttcttgaggtcaggtatgaccttgccaatatcaatattaccaggaaggactggcaaaaacgcccgatttcggtctggagatatcgtgaactgcttcccgtagctggtgaaccggttaccctgcaggaaggaggaactcccctgtaccatctcaagcgtatcggagatgaacttggcattaaggagttgtatgcaaagcacgaagggatgaatccctccggatcatttaaggaccggggaatgaccgtcggcgtttctatggctcttcagctggggatgaaatcagtggcctgcgcaagtaccggaaatacatccgcatcacttgcagtatatggggctaaagcaggtatcccggtcatcgtcctgctcccgtcaggaaaagtggctcttggaaaggttgcccaggcactcatgcatggggcaaaagtcatctccatcaatggaaactttgacagggcactggagatggtccgtgacctgtgtgaaacaaaaggcatctacctgctcaattcagtcaacccctaccgtcttgaagggcagaagaccatcggatttgaagccatcgatcaactcaacggtgaggtccctgaccgaatggttctgccggttgggaatgccgggaacatttctgccgtctataaagggcttattgaactttcagaactcgggtttattgacaagatgccaatgatgaccggtatccaggcagagggttcccaaccggtcgtgagggcaattaaagagaacctgcctgaagtcattccggaaggatcacctgaaaccgtagcaaccgccattcgtatcggtgccccggtcaacgcagagaaggtccttcatgcgatccggatgagcaagggaaccgcggattatgtcaccgatgcagagattctggccatgcagcgtgatcttgctcaaaaagagggtattggtgttgaacctgcatctgcggcatcagtagccggtgtcaagaaactggtcgaggctggggtcattgatcatgacgagcgtatcgtatgcgtggtcactggtcacctgctcaaggatcctgaaacggtaattaaacaatgtgctccaccaatcgaatgcggcgctacactcgaatcactgctttctgccttacagctctgatcctatggatcctgccggttgccgggattaccttctcggcatccgttgatgaagatgggaaaggatactctgctgtcgttctggtcaataataccgaccggtatgaactgattcagccggggatggtcggcgagcggatacccctggagacaaaaaacctcacggttcgaaatgagactgatatcttgtcgctcactcctgaccgggggatcctcacttttcccagggggaactattccatctcctatgaagccatggtgaatgcaaacaccatgcagttcctctttactgaaccggcaaatgtgactgtgagcatcccccggccgttcatggtaacaaaccccctcctcacgtccatccagccatcagggtcaaaacttgaagaagggaataataccacgaacatctcctggaagcaggtccgatcggttgagatcagatattatgatgaaggacaagaacatctgctctatctctttgcgcagttctggctgatcatcgctgtagtattgttattaccgttttttttatccagaaataattagcgcacatcttcactcccggtggaagaacatatcccatcaaacccccatttggtgccccaaaagtgacctgaccatatgcggcacctcatgaaattgacctcatgaaggatgatcaggccatcagtcagaacccgactgacaatgatgaaggaaaaatgcccggaaatttcccctttttctcacaaaaaatatgacctcatagttgtttttattagaaaataaacgaaaatactggattttataatgatcccgatgattaaaaaggcctgaaatcacgcgcaagccctaaaacaaattagaaatgacttatttcaattatacgccgagatcaaaatcccatttttgccgtaaaattaaatttcaaggataaatcgatattttttcattaaaaaggttttaaattgcctaaaatcaattttaatagccaaaatacaaaatttttcaatttgggcagttttgatcagagtaaaccttaaatcctcaggcatacacgtgaatgagtcaaaaggagaaacaccatgatagacacacttgttccaaccagagaaggaatcgcaaccgcaccagcaaaatcagatcaggagattatggaggagtttaaatccagaaacgcctggggtctgtatactagcgttgatctgaagaactgcaacccggaaactatcagagatgcaggaaagatcagggaattcgtcatccagctctgtgacctgattaagatgaagcggtttggagagccacagatcatcaactttggtccatgtgagcgtgtagcaggatattccatgacccagctgattgaaacctcacttatcggagcacactttgcaaacgagaccaatgctgcctacattgatatcttttcatgcaaagaatacgccccacaactcaccgctgaattctgccgggaattctttggtgcagataaggtaaccgttcatattgcattccgggattaaaccctcaatacccttttctttttatcccttttaaaacccgtcggtttgactctgaaaaaatgattatgctgccagcacggctttggcaactttttctccaaatcctgccgcagcgggaggaccattcgcagtaataacccgtccatcagatacaatcggatcaggcttgtacgtcgcccccccttgccggagctgatgaatggcggcgtcatcattccataccgttgcctgcttccccttcagcactcctgcctgtgcaagaactactgtggaaagacagatggcagatagtatctttcctgcggcatcaaactcctggaccagggtctggagaggtttattgttccacaggtgatccggcgaaccgcctccacccacaatcagaattccggcatagggagtaatccccgcctcgctgacatcacgaacggtcttttcaataagaaccttcccacccagcatcccgattgcaagaccggtctgtgttgagatgatatcatacccgattccagccttttcaagatattttatcggttcggagagctcttcatcgcgaaactttaccggggcaatgacaatcagaaccttcttttccactgacatgctcctcactgcagggaagtctgctcgcaaatcaataaaggtatggatctgaagtcaagaaaaaaagaagagaagatggggattactgtattgattcagaggcaatgagagtaaatttgtgtgaatgaagcaaacgaatcgcctcttcaacctgatctacccgcaagatcagaattgccttatttttaccagagaaggcataggagtactcgatatttattcctgcttcactgagctttgatgctatctcaaaaaggccgccaggctcatctttcatctcaaccgcaatgacatgggtgaatgcgacattaaaacccatggaggtgagtttcttaaatgcaacatcaggtttgtccacaagtgccctgatgacaccaaaaccctccgcttctgcgatagaaaaggcaaggatattaacattctcctcctgacatgcctttgccattgcagccagtctgccaggtttgttctcagaaaaaagggagatctggcggatcatatactgttcacaactcattatatcaacctcttatcaatcacacgttttgctttcccttcaaaccggggcaaggttcccggctctgtcagttcaaccgatacctgtacattcaatgagctcttcaatactttttcaacatgccgctgcgtacgcatcagatctgaaatcttatcggaaaacgcctcctttgcaagctcaactttgatgagcatctcgtcaagggcgccttttcggtcaacctctatcatgaagtgttctgcaacttccggaatcccaagcagggcatgttctatctgactggggaagacattgataccacggatgatgagcatgtcatcgaccctgcctgacaaccgttcaagccggggatgggttctgccacaggggcatggatcttccctgatcgcggtaatatcaccggtccggtatctgataatgggaagaccatccttttgcagcatagtcaccaccagttcaccacgctcaccaggcggaagaggtttttgtgagtcaggatccagaatttcaggataaatcagatcactccagacatgaaagccctgctgatactcacattcacaaaagagcggtcctgaaagttcactggtcccgtagatatcataggcatcaaccccaagactctctttaatccgaagccgcatctgctcactccagggctcggctccgacgatggcttttcggagacgggtgtcatttttaattgaaacccccatcttctctgcaacctctcccatatgcaggaggtatgacggtgtgcaggcgatggcagtaactctcagatcctgcatcagctcaatctgccgctcggtattcccaaccgatgtcggaaggactgttgcaccaatccgctcagccccataatgaagaccaagaccaccggtgaagagaccatacccataactgacctgcatcacatctccccgtccgataccggcagatgtcagagcgcgggcgagggattcggtccagttatagatatcattcttcgtatatccgacaaccgtgggtttcccggtcgttcctgatgacacatgataccgaaccagttcctcctgttcgctcatgatcagaccgtcagggtacgtgtcccggagatcttttttatgcatgaagggaagccgggtaatatcctccagtgaattaatgtcatcaggatgaacccctgcttccttcatgcgcttgtgataaaatgaggaaaaactgtaaacccggtaaacaagggtttttagaagtttaaactgaagttttcgaaggtcagcgacgggcatctcctcgattcgcgggtcccagcaccgcatcagtcatcaccccgccggtcaacaacgcgttttgcttttccttcaaaccggggcagagttccgggttcaaccaggtgaaccgtggtcctgagctcgagaacatcgcggagggactttatgaccttattctgaacgttctttagatcagccagttctccatggaaattctcacgggaaacctcaacatcaatcgtcatctcatccatatggtttacccggtcaacataaaccatgtagtgattgccgacctcagggatggaaaggaggacatgctctatctgactggggaagacgttgataccacggatgaccagcatatcatcacttctgccggtaaagcgggcaagtttttgacctcggccgcagggacactcgtcctccatgatcatggtgatatcaccagtcctgtaccggaggagcggcatagcttctttcgttagaggagtgactaccagttctccccgttctccaggacccaggttctcacctgtcttgggatcaataatctcaaccagataggagtcatgccagatatgaagcccgttatgttcggagcattcaaaggcaaccccaggaccgtagagctcactcataccataactatcaaatgcctccacacccagtttctcctgcagttcgttcctggtcttctcggaccagggttcggcaccaaaaatacccactctgagggaagacagatccatcttcatctcagctgcagcctctgcaagatggagaccgtaacttggagtgcagtgaatagccgtaactccaaagtcatgaatcatctctatctgccgtttcgtattgccagttccgcttgggaccgcggtcagacctgccttctcggcaccatagtgaaacccaagtccgccggtaaacatcccgtaattaaccatgttctgaaagacgtcatctttcgtaagacccaccatggtcagatttcgcgcaatcaaatctgcccaggtgttaatatctccggcagtatacccgacaaccgtgggttttcccgtagtcccggatgttgtatggatccggacgatatccttgagcgggactgcaagaaaaccaaaaggatacccgtcccgcaggtcagtcttccgggtaaatggtaatttctgcagatcctcaatcgtttggatatcagacggacgaagcccggcttccttaaactttttctggtaaaacccgacattggcgcagcgggacactgtttcccgaagacgcttttcctgaagtatcttcagatcagcaggttttatcgtctcaattgcctcatcccagaacataaccttgctatcctgaactcctcttatgagaagtctgtgataattacgttggaagggagagtgaataaccattgttacacgataacatggatcatggattttgataaataagcgataaacagatgataagatgtaaaaatacggacaataattcagttatttgtatggggttgtcgggataagccctgaattgcctgacaggtctccggggaagagcaaccctggaaaaacccattcctttatcttttgatactgccttttagaattatatgcaggttgtcggcatcaacagcagcccgaggaagaagagtaacacagatcttttactaaccactgttctgaccggtgcctctgacggtggatgtaaaacagtccatatcgatctttacaattacgagatcgagtattgcaaagcctgtgatacctgttacaaaacaggatcctgtgttctcatggatgaatttcctgacatctatgaagtcatactggaatcagacgggatcattctgagcagcccgaactatatcaacaatgtcaccgccaagatgaaaaccctccttgaccggatggccgatacggtccattgtcagcggcttttaggaaaatattccgcagcggtcagtactgcaggagggtccggagcacaggaggttgcagattatctgaaccagtcgcttttcatcatgggggcctctgttgttggatcggtgggggtaaacctcgctgacggtgaggagatgtttcaaaaaggggtggatcagtcctatcagctcggaatccagcttgccgatgcaattctcacgaaggcagaataccctgaccagcagcaaggacatgcagccatgttagagcggatgaaacaactggtgtcattcaggagagaagagtggccctatgaatacgaatactttacacataaaaagtggatatagaggagaatattcaggctgttttaatcctggcaacttcctgaagaccgagcatctcaatacccatctcccgcattttaaacttctgaatctttcctgataccgtaatcgggaaggaatcgacaaaggcataataccgggggatcttataccgggcaatcttcccgtctgcataggtccgaatctcgtcctcggtcagagaagccccttcctcaagttttatccatgccatcagctcctcaccatacttctcatcagggactccgatgacatatacatcggcaatctttggatgctgatgcaggaactcttcaatctcccgcgggtagatattttcaccaccacgaatgaccatgtctttaagcctgccttcgatatggacgaatccttcaggatcaaatgaccccaggtctccggtatgaacccagccatgctcatcctttgcctgcctggttgcagtagggttattgtagtagcatcgcatggtcatgtaacccctcgcacagatctcaccaatctctccacgggggatgatcttcttcgtctccggatcgatgatcttgatttcggtatgggggaaaacccgacccacggtagtcacccgtttatcgagcgggtcgcgggtagtggtcatcgttacacccggagataattcggtctgaccatacacaatgaccacttctgacatgtgcatcttggttgcaacctctttcattgtctcaatgggacagggagatcctgccatgatgccggtccgcagtgatcggagatcgaattttgcaaagtcaggatgccggagctcagcgatgaacatggttggaacgccatgaactgccgtgcatcgttcggcttcaatggttctcagaacatcccctggatcaaaggccgggccggggatgaccatcgttgaaccatgcgagacacaggccatatttgagaggaccataccaaagcaatggtaaaagggaaccggaatgcagagacggtccttctcggtaaagcccataccctccccgatgatgtatccgttattgaggacaccatgatgggtcagcacaactcctttcgggtacccggtggttcctgatgtatactggatgttgatggcatcatcaaagtcaagtgctgcttcgcgctctcttaattcatcctggctgatactttctgcttttttcaggaggtcatcccactggtacatcccgttgtacggaatatcgcccatgaataccacggttttaaggaacgggaacttctcagagaggatgcgcccgggccgtgactcatatgcctccgggcaggtctcataaaacatacccacataatcagaggttttaaaacggccctgaaggatgagcagtttgatctctgactgtttcagacagtattcaagctcaaatgtccggtacgacggattaatattgaccataatggccccaatcttggccgtcgcaaactgcacgatgatccattcggcatagttcatcgcccagattccaacgcgatcccctttgttgatatcaagggccataaggccccgggcaacctgatccaccgcctcccgaaactgacggtatgttagtctgatctcctgctttggcgatactatcgcttcgttttcaggatacttctctgcaacctcgttcagaatatccccgatggtctgtccaagtaacgggaaatcggcagtcccacaggcataactcagttcgggagtggccattgaatccattcatctcaggtggactctccgtgaatttatctgtcgcgactgacgatcataatctttaaattcgctttcgtattacctatatgagcacaggggtcgtggcctagtccggcatggcgacgggctccagcggtctttgcatccggtgcagatgatgacaaatgggtcttctgatttggtgatgatccgttggagcactgatgcatatcggagagacccgtcgatcgtgagttcaaatctcaccgaccccacctgttttcataacctctgactttgcagaccataggctgcactggtgatttatagtctggtcgctgaaatataggggaaggttatcatatgtatctgataggcgaagccctgatcggcgaaggatccgaactggctcatgtggacctgatcgtcggagataagaacggtccggtcgggatggcgtttgcaaatgcactctcacaactctcagccgggcatacccctcttctggctgttgtacgtccgaatctgctcacgaaaccggcaactgtcgttattccaaaggttactctcaagaatgagggacaggtcaaccagatgttcgggcctgtccaggctgctgttgcaaaggcggtcgctgatgcggttgaggaagggctttttggtgatataaatattaacgatatctgtattctggccagcgctttcctccatccgtcagcaaaggactataaccggatctaccggtacaactatggtgcgacaaagcttgcaatatcacgtgcatttgaagagttcccggatgaaaagactctgattcatgagaaagaccgcgctgcacatgctgtcatgggctttaaggttccgcgcctctgggacccgccatatctgcaggttgccctcgatattgttgacctgggcaaactgagatctgttctctcatccctgccggagaatgaccacctgatcatcgaagcaggaaccccgctcatcaagaagtttggtctgaatgtcatctctgagattcgtgctgtaaaaccaaacgctttcatcgtcgcagatatgaagattcttgataccggaaaccttgaggcccggatggctgctgattcatctgctgatgccgtggttatgtctggtcttgctcccgcatctaccatcgagaaggccattaccgaagcacgcaagaccggtatctactcggtgattgatatgctcaacgttgaggacccggttggtctcatcgccagtctgaaggtcaagcctgatatcgtcgaacttcaccgtgccatcgatgctgagcacacgtcccatgcctggggcaatatcggtgacatcaagaaggcagcaggcggaaaactcctggtcgcaaccgctggcggtatccgtgtcccggttgtcaaggaagcactcaagaccggtgcagatattcttgtggtcggcagagcaatcaccgcaagcaaggatgtcaggcatgctgcagaggagttcctcgagcagctgaataaggaagagatcgatcagttcagaatcatgactgatttctaatcaaatcttttttatccaatcagatctggctgttgaaatacagaagatacgaagacctatattgattctgactgaattacctataggatgaaatatttcaataccgccgggcctgttaactgcaaagatcattattgccttcctccgctcagtcgattcaatctttcagagattctcggacttatctcccagaagaaatatttcgtccttcatgcaccaagacaaagcgggaagacctcatgccttcttgccctcgagaattacctgaacgcttcaggatcatacaaatccctatatattaacgttgaagcagcccaggtggccagaaataatgttgaaaaagggatattcgcaattattaatgagatacaacgaagaattgaactttccggatatgatgacgattcacaaagaattgtgaaagatctttgtgatccacacctatcgttatctgcactgaacagtgctttaaccaggcttgcagagttatctcctttacctctcgtcctgctcatcgatgagatagatgctcttgttggcgacaccctgatatcggttctccgccagattcggtcaggttatgattcccggcctgaccatttcccatcaacagtgattctctgcggggtgcgtgatgtccgtgactaccgaattcattcagataccgaacagatgatcatcaccggtggaagtgcctttaatgtcaaggcagagtcacttcgccttgggaatttttctgaagaagaggtccggactctgtgccttgaacatacgaaagagaccggccagatcttcacaaccaaggctctttctaccatatgggatcttaccagcggacagccatggcttgtaaatgccctggcatatgagacctgttttaaactggagcacgggaaaaaccgtgataatcccatcacggatactatggttgaacaggccaaagacaacctgattatccggagagagacacatcttgatcagctggcagacaaactcaaagaagagcgggtacggcgagtaattgaaccgatcctcacgggagatctctacgaaggaatgctccgtgctgatgatattgaatatgtaaaggatctgggccttatcacccaggcaccgaacggggagatatccatctcgaacaggatataccaggagataatccctcggcaactatcctgggaaagtcagtccggtatggctcttaaacaggcatggtttgtcgatgatgatggaagactcaatatcttaaaacttatcagagagtttcagcagttcttcagggagcattcggagagctggattgagcggttccagtataaggaagcaggaccgcagatccttcttcaggcattccttcaacggatcgtaaatggaggagggaggattgaccgggaatatggtctgggccggacacggaccgatctctatcttcggtggccacttccggatgggacagtccagaggatcattattgaactcaagatcctgcataaatcacgggaaaaaacgattgaggatggtatgaaacaggtgatgaagtatatcgaccggtgtggtgctgatgaggctcatattattgtttttgaccggagaccggaagtgccatgggatgagaaaatatttcgtgagaagagagagttagaagagtgccgggagaggaacagggtccctgtagttatttgggggatgtaggcagatgttgtgttataattccaattggaacctgattgcctcgtgaatttgttggattaagctctcatcatgaatacacccaatttctttcttaagtcgccttttatccactgttcgtacttgataacacagggcgattgaatcggcaaataaattcgcagattcctttggaataaatacttcatttggatagataatcctttcctgcgattttcgtgatgtgagaggtatgatatttactacggggagaatctgatttatctgctcacgacttatcacaaggaccggcctttgaccagactgctcagatccacataccggacttaattgtgctacaaaaatgtgccactgatacatcaggactcatgctcccaccattcatcatcaaccgatgtaaaagaagccatagattcttcaagatcggtcatgaacaaaggatcctcaattgctctatgtagccttttcagcttttcgttaacatcagagtgtggcccgatttttggcagattttgttcaatcataagatattcatccataggcaaaattaccccaatgggattgccttcactatcagtaataatttgtctttttaagatagattcagacatattctttctcaccatttccaatataatagagaaatcattgaccttatcctttattattccgattttctatgtcctttaagagcaaaaatattactcataatcttgaccaccatacccatagttaaacaccctacatcataatcacaatacaatacatatatataccaagaagtcgagttctctcatacctttacagaggtgaaaattaatgggaatcggcgaattactcagtgactcatttggctatgcaaatgagggattaatcggaaaatgggtgcgatggattattcttattatctcatcgattatcttccctctgattatgggatattcactccgggttatgaaaggaaccacacctgctccggaaccaggtgactatcttggaatgttcatcgacggaatcaagatgatcattatcgagattgtctatatgataattccaatcatcattgcaatagcaactttctctctgagcggaggatttggaagtgcagcaatgtacgggatgaatgtagacaatccacttgcctatttcgggatgctgattgctacctttggtttatccctggttctcttcatgattgtagccttcatcttttccctgtttggaattatcggcatggtacggtttgcaagaaccggcagcatgggagaagcatttgcatttggtgagataacgaataccatcgggaagatcggatgggtccagtacatcattgcccttatcgtgctcttcatcgtcatttttgtaatctatgcaataatcggaataatacccgtaatcggaggaattatcgatcttatcattgctccttacatcgtaatgatgacctcacggtactactcaaatctctacgatacgggtgcctgatacagaaaatacaaaaaacacttttttttgagacgaatattgtccggacacctgggtaattatcgtatcacacctggttttttctcacccgaccggatatcacaccttcagaatcaaatagcatagaataccaaaaccctgagagataatcatgccgctcaattcccccgcaggtattgatcaatcagccctcacatgccttcttgacgacgcgtgttttaccagaaaacacagaaaaatctggttcctctcatcgatgggtatcctccttgacggatttgacctgtttgtcctttcagtcgccctgcctctcattattcattattttggtgctacagcattacaggccggtctgattggagctgctgcaacacttggggcgatagcagggtctgtcatcggaggccgacttactgacaaatacgggcgaaagaagatttttctcctggatctcggactctttgttactgcggcaatatgctgtggaatggcatggagcgtggaaagtctgatactcttccggtttattcttggcctcggtgtcggggcagactatcccatctgtgcatcctatgtctcggaattcatgccaaaaaacatcagaggcaggatgcttatcggagcattctcattccaggcggtcgggatattccttgctgcagccatcggactgttaattctggttctttatcccaatgaacttgcatggcggtttatgcttcttgtcggtgcaattcctgcaaccatcatccttgttgcacgacgggacattccggagagtgccagatggcatatgaagcggggtgaaacaacggatgcaatcaggattatctgtaaaactctgcatgatctgccaggagcaatgaaagactgcatctcacaattccggatatcccaccccaccatcaatgaaaaaccagacgtgaaaagtcagccctattcagttttattttcaaaggagatgcgaaaaaggacaatacttgttaccgttccctggtttttgatggatgtggtcttttacggaattggaatatttactcctcttctccttgctgctatggcatttgaagggagtggaacaaatttcatcgcagatgatatcctggctaccgaggggacggcatttcttgatatcttccttatcattggatttattctgaatattatcctgattgagcgtattggacgaatgaaactacagatcatcggatttacaggcatggcagtgggccttggtatcctgattattggatccctgtacaattcaaccatgattggccttctctttgtagggtttgcgatctacaacctgctcatgaatatgggaccaaatgcaacgacctttgtcctgccggcagagttgtatccgacagagatgcgggctacggcacatgggtttgctgctggaatcgccaaactgggggctgctctgggtattattcttgttcccatccttaaggaggggtggggtataccggtaacgcttggagtcatgcttggacttgtcatattggcccttattatcacattcctgtgcaggattgagacaaccgggagatctcttgaagaaataaccgattagcttcacgttccacccaccatacctttattacttccataaacatctgtatcttatatgacgacagaggacgtgctcaaagagacaacaaaaaatatcggtgatctcatatcagccaggcgagtgatgggtgacccgattgatctcggggataaggtagtcataccggttacgaagtttggactggcgttcggagcaggaagcaggaaagaaaaggaaggagacgggagcggtgctggaggtggcgggggaattgaaccaatggctctgctggtcgcccataaggagatcaaaggagcagaaggaatccaggtcttttcgttaaagaaagaaaacccggtcgcccaggtgataactgcactgagtgaatcactcgtgccccaggtcatcgagctggtcaaacagaaagaaccgtcatctgccaatccgactgaagaagagaaatcataggagtgcctatgttccatccggctggtgatctggttgtcacggtcggcattatcctgtttttattcatttttttgagatttctttacacaataccgctgaaaatctcactttcagcaatcaggggttcaagcaggttgtgtggggagagtgaagtggggcttggacaattcagtattgcggttctctatgacgggaccttattcggggagatgagaatcggcgggaggcgtcttttttccttttccataccgaaaacaggggaggagggtgcaaacaccgatgaaggaaaaccagaagcagaaagtatccgatccggtatgagatggataccggtgatcgttcagggcagcagacgaatcatcaggcatttcagaatcgataccctcacctgtcatgcacggataggttgtggtgatccctgcacgaccgggatggtgtatggatatattcaggcaattattccattgcttccgggagaacatgacatctgtatagttcctgacttttatgatccggttctcgaaggtcacgtcagactggatacccggtttgtgtaccccttcgctctcctcgtctatttatccaggataatcattccggaggttctgaataaaccagtattatctggagggaggattgatgcagaatacatatgatacaatacggatcctggaaccggttgtgcttgccggaagagagatctacccggttgtaaaggtacattcatggatagggaagcagggaggaatgatattgggaaccccctgtgccctgctcatccgggaagatgaggcatggttttttgtatcagttgatgatacggtccccgatataacatcactattttctcttaatactcctgctacacaggaaagataatcaatgccaggtccttgaatgcatgataaaaagagggttatcataaaccggtactatcctgcttcctgagaagcccacataccggctggcagaatggatacaatacctgctattcgccaccggggggaggatcaagggagaaaaaggaataataatgttcgactacggtgccacggacaagaacgtcggctggcatgatgagtaattccctgagtaccagatagtgcttttgtatagagactctattgcacccaggaatttctgctacgataccatcacaaaccccggattgactctctaataatgaattcaagttgcaaagaaaaatttaatacatgatgtaataataattgtattacatggcgaaaacaaaacctaagagacatgcaagtgtctctctccgaatgcccattgaattaaaggatgctcttgaaagctatgtggcagaacatgagatgagctcgatgtcagaagctatcattgcaatccttgtagaaaaattgaacccgcctatcccgggattatgctggccgtgtaactaccagaacccgattgatgcgaaattctgttgcagatgtggaaagaaattgaagactgatcaataatatgtactacaaatagtagtacaaatatacatacaagtattaaatacagattacgatgaggtatacaagatgaaaatcgtcagcattatcggaagtcaccggaaaaacgggaacacagagacaatgcttaaggcatttgacaaggagttcaaagcactggagattccggattataagaataaattttacaacatctctgagatgaatatttatccgtgcagatcctgcctgaagtgcatgaggaagaataactgtgtaattgaggatgattttggaaaagttgcactcaaaatgatccagagcgatctcatcatcatgggctcaccagtatacttctctgatgtcagtgcccagattaaagccctctttgaccgaacctactccctctggcacaaaaagatgttaaaagggaagaatatcatcttcgtcgctacctgtgcagagtatgggtccggacataccatcgacaccatgaggcactgggcattggatcatgagatgaatatcatcgctaccgttgagggaaaaagtgagaagaagggaaaggtcctagagaatgagatgaccgtgaaagcaattgccgatgcagtccgggcatgtgacgggataatcccaaaaacagaggaaaactgaaataaaaattcaaaatcaggtgtttttctctgaatcaatcatcaggtattccccatgcccttcacagacctcacaatagagatctatatagggaaaacaccgtggacagagatgatatgaagctttaccattcatcatatggatgaatatacctttttttgaattttcaggcatcatcaccattatatccagatgcaaaaccataatgatatggtatagagaatctatagagatccgaaaaatcaggattcggattctccataatcgttttccttcaaattatcctgcaatcttaccacgggaatgatattcaggactataccggctgatatagtacccggcgtctgagagaaactgcattgcatcagtcaatgaccgggcatgaaatgatcctgactcaataggaagcgtatctgccatggtatcatcgaatgactcatacacaggataacttcttctccagagaatctgaagcggcgccatatgacaggagaatgaattcatgggatttggatatctctcaaataattgtatggtgagtgataatcctttgattttaataagggaataccgttcatgatactcatccataaaaagtccgatgatcagagtatcccgatcctttatccccagcgtaattggataatcgaaggaatcactccctctcatccggttcacgccttgcatgaatgcacggatcataaagcgatctgatgattccagattatagcaatatgccccatattcttcacgaggggtaagatgatgaatcatctccttgagtgtacatcgggcaagatggatgatcccatagagagtgtcagtattatcggtcccatgtatccgaaggaagggaagaccaggttgatttgtaatgcaatcaggatcccgaagtatttcattgaaatgtaatatcctgtttctaacctccatagcctcaaatgacctctccggaaacaatacagacattcccataaggagggactcagctatgacccgtaaatcttcagaaatcctgtcaaaaagtctgaaaactccaggaatcgtaattattcccgaataatctacggatgatccctctatcataaaccggtactgatctggcacggcgtgatgagaatacaccgattccctatcaacacaatataagccatactgagcatgctcaatcgcacggtccagaacccgaatgaatagagacacatcatcggtggcttcaaagcccttcaatattgccttctttttatacgtgattttttcaagacagagatcacaatcaatcatatatcctcctttcttctccagggcaagggaaaatccaattcgtaagagaggattttcataaacatatctccattatccggatttagaaaggatatacccggattacagagaccctgcctatcaggaacacgaatccataacggcaggcagatgattctttctagccgataaaacaagatgaatattttctcatgtaactatagagacccctatattaccggaggaaatcaccgaatcataaaaaatacgaacagaggaatggcagaatacagatgtcagaaaaaaaattaaaggatcatatccccgttttcacgggtctgaatccgtatggcttcttcaaccggaataataaagatcttaccgtccccggtattgccggtaaatgcactttcacacagaatattaattatctcctccacatgttcatcctccacaaccatctctaccttcaccttgggcataaaatcataaagagattcgatattatactggtttatctcccttgatgtcccccggtaccagatatcataattgatcatcgaaccatggcccatggctttcatagcatttcttacatcattgatcttctcaacccgtacaaacgcttcgacttttttcatccacaggaatagagatttaaaagtaaatattattttcagtaaaataatatagagatataaattaaactatattcctcacagagacatcagagatcctatatggaattgttaagggaatacagaccccagagatattcatcgtaccgcattggttcaccccctaaacctgatgccatatgaacaatgattccattataactggctttgatctctccggatattaccagaattctgcaggtttccatccggtaacggaatacaaaaaatcaccagaatcagccgacatccattctgatggtatcatctcacacgatccatccacacttatgagcattcttgatgctgccccggtagccattcagattgtcggtcctgaagggacattcatcgattgtaaccggcaaaccctggaattattcggagcacgggacctgcacgacattgtaggaaaaccaccatcccttctctctcccccggttcagaaaaacggggaggacagtcaaaaggcctctttgacccagattcaggaggcgttttctgggaaaagagttactttttcatgggaccatagaaaactctccggtgaaatcttcccagctcgggtgacattaaaccagatacattacgaaggaacaccctgcctgatggcctctgttatcgacaccagcgaacttgtggcacaactggatgagatcgcaagtcttgtgaaagaatcgccatatgcaatcttctctatggatccatcccttcagatacgtgatatcaaccaggcaggagttacgataaccgggtatacgcatacacaggcatgttcaatgaatttcagagatctctcattcctcgaatcacatgggaagaagatcgaggacgcaattcagacaaaaaaaccggcacatgggagagcaatactccagaccccacagggtatcagatatctgaagacctcctatatcccagtgctcagtcaaaaagaagagatatcgaaaatatatgccgtctttgcagatcagacctcactcattgagaagatgaatgaagcagaagccctgatccaggaaaatcctgcaggaatcctgactgcggattcagaaggcaggatactctctgttaaccaggcattcattgatatctgtcggataaatcaggataaactcctgcagatgaggttaggagattttctcattacaaaaaaggaaggagcaggacttaaagaggcaatggcctcgaaaaaacctgagaaaggtaggattaccgtagattttggctcacacagcagaattcttgattctacatacattccggtcctcaatgtgaataaagatatagaaaaattggtcctcatgttcattgactgtaccgaagtacaacagcttatcgaatacctggaccattcggtgacagccatctctcaggatatcactaatcttgcatccggaaagacggattttgcatcaaaggcaataaaagggaacgagtatacgcaaaaagcagaaaaaaatctgaacaccatccatgaatccattaactcaacaaggctggcacttgaacacattatcaaagatattgacagaacaactgatgctgcattatcaggagatctgtcattcagggcagatccatccgtacaccagggaaatttccaaaatataatagagaaactcaataatacccttgatgccacccttactccggttgccgaagccatgtcagtctcccgtgaatatgccagatataactttaccgcacggtttaaccccggattagaggtaaaaggtgactgggtcgcctttaaagacgctctggaccagacagggaatgcaatttcacatgccatttctctcctgaaccagaaaatcagtgaactttcagcaagcattgaagaagcaaactcaagtgttgaggagatcacctccggatcacaggaaattgcctctatcatggagaatatcagtaaaaatagcgagtcaggagattcttcaatcgcccagatcatccgtgccatggaagatctcacccggacggtcagtgaggtctctcacaaggcagatcgtgttgcagtactatcacaaggggcaaccgtatcagcaaaacagggaatggaacgagtcagacgatcagaacagtcaatgtctgaaatcatgaccgccgcagaacatgtcgataccattgtaaaagacattaatgcagagatgaatgagatcggaaagatagtcagagttatatcagacatagcaaaccagacaaaccttctctccctgaatgccgcaatagaagcggcccgtgccggagaagcaggaagagggtttgctgtagttgcatctgaagtaaagtctttggctcaggattcacgaacgtcagccgaaaacataactgagatgatcacaactctccagcaaaaagcaaaaaccgctgaggatgcaatggcccagtcggttcaggtggttcatgatggcagttcagcccttgctgagaccgttacctcatttactgacattgcacaggcaattggtgacattcatcaacatattactgacgttgcagctgcttcagaagagcaggcggcatcagtagaggaagttaccgctagtatgcaggaagtggcatttctcacccataaaacatcagaagaagtcatcaacacatctgtcgccataaagcagacctctgcagccctggaacagatcagtgaagtcgtaaatacgattgtcgtcatcagtgacggagtacatcaggaaatatcccgttttaccgtagggtaaggtgagcagaatgactcaacgattgatggatacaaaaccgcaatcaaaaccacgaacggtgacaagacaggagatgcaggttatcgaatttaatcttgggacagacagatttgccatagatatccaaaatattaaggaaatcgttgaatatacacgaattcgacccctccctaactcaccccccccacataaagggtatcattgatcttcgaggagaaattaccaccatcatcgatctggctctctttatgaaccaggcatcaaagacatcagaggagaaaaaacgcattattattcttgatatcatagagaaaaaccacaaacttgggttccttgtagacgatgtacattcagtccttgccatagaccagaacctggttgattattctgttcaccaggggcatgatgatgccgggcatatccagggaataattaaaaagagatatgatgaggggcaaaattttcatacagatctcatcatatggctgaatatagaacagattctgcttgagatataaacaggatatgcatgcagacatatcaaaaaatcccggatgagatccgacatccctcatgcatatccaaaaacatttcatccccatatcaagccggaactccccaggcgacaaaacagatcctgtacgtcgatgatgaagagatcctccttgaagttggaaaacttttcattgaacgatccggagcatatcatgtcacaacctgcaacaatcctctaaaagcccttgaacttctcacatacaattcatttgatgcaatcgtttcagattatgagatgcctgatatgaatgggatacagctcctcaaacaggtcagacgaacaggaaaccagatccctttcatcatttttaccggcagagggcgggaaaaggttgtaattgctgcactcaatgaaggagctgatttttacatccagaagggaggtgaaaacagatcccagtttgctgagctcgttcataaaattaccgtttcaatcgaacgccgggaagtcctgcttgcacttcaggaatctgaaaagaaactctcaaatatccttgcagcccttccatatgccacctttgccattgatgccgaacaccgggtaattgcctggaataccatccatatatccatatgaagaaggcagcagactctgaaaagtatataaccacataagcaaatacctatatgctaacgtatggagatatgtaaccagtgtgaggactgtacaaaactctgcgagatagttccaaagatggccggagtattcaaagcccttggtgatctgaccaggctgaaaataatatatctcctcacctgtgacactactggaacccttggagtatccgagcttgcatccagacttggcatctcccaacctgcagtatcccagcatttaaaaaccctcaaatcagaaggcattgttgattcacgccgggacgggttttatatctactatactatcaaccgcgaccggatggtagaattccgggataattttgaactgatgtattcgagtgtcatgggaagatgcaaccgggaacttatcaggaaatcctcacctgatcaggaaatccgggcatgtgtcatctattattcatactcaggggttacccgccatatagcagaagagatacgaaatgccagcgggtgcgacatcattgagatcagaacgaaaaaaccctattcttccttttcagcatatacaaccggagtttttcgatcccgaaagatggcatgtgacccaattgaaccagattccatagatgtttcagcgtatgatctcatcgttatgggaacaccggtctgggcatggaaaccagcccctgccatgaatgctgccgttcaagcacttaaggggtgtgaggggaagagagttgtcatctttaccacctgttgcaatcagcccggtgaagccctccccattctgaaggaagcactgatcagccggggtgccatcgttgtcctggagatctcactaacatcagaggacacaaaaaatcctgatgccgggggagaaattctccgaagaatcatccaggcggaaccattcggagataccacaaaaacaccggattcagaggagaaatgagcatgacagatccaaaacaaattctggttatcatgggcagcccccggaaagggaacacgttccaggcatgtgaaatgttcagagagtacctggagcaggagattccggttcaatgtgaatatgtctggctgaaagacctcaccctgcacccttgcagaggctgtcttctctgtttcaccaaaggagaacaggcatgccccatccagaatgatcctttcaggatttcagatggagtgtcccatgagtgagcagaggatctctcccgaggataggcaggagcagtaccgggacctcttcaacacgaccatcggtgaggtcatcagtcatgctatcaggataatcggggccgatccttcactcatcatccctgcaggaaaaatactccggtaccagaagaaggcagcgaaaatccgggccaaacacgagaaagaaggactccaggtcccaccggtcatgatcatcagcatcacctcacgatgcaaccttacctgtaaaggctgctacatgcatgccagaaatgagaatccaagaacggaaatgagaccggatatcctcacatcagtcattgaccaggctgctgatctcggagtctccattcttgtcattgccgggggcgaaccccttgttcgggcagatgagatattccgtattgcacaggctcatcccacaatcctcttcccggtctttaccaatggcctcctcatagatgaacagatggctgacacccttgcatcataccggaatatcgtccccctgataagttttgaaggacttcggcatgagactgatgcacggagaggggatggagtatttgaccggcttattactacttgtcatctgctctcatcccgtggcatcttctttggctgctcaatcacggctaccagggcaaatcttgagattgtcaccggtgacgtatttatcaggcagatgactgatgcctctatcagggttttttcctatgttgaatatgttcccatgacaccaggaacaatagatctgatcctcacccatgaacagaagcaaaacctgccaggcatactcacccgtctgaaccaaaaatacccggcactctttcttggctttcccggagatgaagcatactatggaggatgccttgctgcagggcgtggatttgttcatgtcagtccgtccggagatctcgagccctgcccggcagcatcatactctgatgcaaacctgactgaaatgccactgaaagaagcgctgagatcacgattccttcaaagactgagagatatgccagaagtgctgacagaatcagcgggcggatgtgcccttcacgaaaaccaggagtgggtgagggaaattctctcaaagacataactttccgccgtcatctgtcaggagcgggcggcgttgatcttctcataaagcaggaatcccgatatctccagcatccgaacgggaccagcatctcaaatctgaccccctgacccggcacgccgttttcggttatggaaatcccggtaaatgaaagtatctcacgaatcaaaaataatccaagaccggtatttttcccatgtcctttctggaatataagacccttttcactctctgcaactcctaccccgtcatcacaatacacaaaccggcacacatctccggatatctcatatgacagggcaatcctggtcactccttccccatgccggatagaattttcaataagattatagagaaccttctcaaagagaggatcagcatagatctccaccttttctatcgggatggtaagagaaactccaccagtaagcgatttgaggacatccttctgcaatatctcatctattcgctgccagacaggctcatgaacaccaagatcctggtattcccgtgtaaaatctatcaggtgctggatatcttttccagatgagaagatggtctgcatcgttgttctccactctgcatcaggatactcttccaaaaggatctcactatatccggtaatgaccatcaccttattcagaatatcatgtcgtgttatgctgtttaatagaccaatctgatgatttgcttttgtcaatgctttataagcccgggtaaggctgtcgatatcattgatgagcagtaaaattgcgatatctccctggatggtgatgtacctggttgagaggatagcataccgctcctgaccgtctgcaagcctgatacaggtctcatacttttctccaggctgcagggagaggatttttaaaaactgatcctcgttattggcatcagtggagaaaaaacctaaattttgaaccttatgcccaagcgaacagatttttccgacatcaaaccattcttcacactgcctgttcatatccagtatagtcccgtcctgccgaaatatcagcaccggatccggaacctcctggaaaatggtaacaaaccgttcttcattctcacgaatggccttttcagtctccttccgctgcgttatatcccggataacatacagaatactatcaggccggccctgattatcattaattatctctgaatgactttcaatatacaattcagatccgtctttccggaccgcacggtactcatgaacccccgtattcgttcctgctttcagttgcctgacatcatgtttgaacctggccctatcagcagggtgaatatgatcaagaatcggcatcccatacggtgaccggtccttgtcattatatccaaacatccgaacggctgccggagagaccatgaaaatcttacccagcatatccaccatcgtaatattatcaggagaggttctgatgattgaccggtataactccttattcttttgaagcgtctgctccagttctttctgatggttaatgtcagtaaatccacagataacggctttttcttccagaatggagattgggttggcagacagatatgcccagaaaaaacgacctccccgtgcaagaagtcgggtttcataatccaccagtttctcatgatgatttagataagacataatgtcatgaagatcatcaggacagacaaaaaaatccagaatgggtttagaaattgctttctcttttaaaatcctgaatagatcagcagccctggtatttaaagcaataatcttcagatctgaaacacgaaaaattacagcaggaaaaggtgaatattcaaggagggtggcataatactgtatggtttttttcatctcacgaggtcggaacgattgataaaggaacaaaataccaaaaaaagcgcaggctatgatgaagagaagaccgatcaaagagatgaaattatttatatccatagttcagccttacatcttcgtgaattatctacccatcctgcattgtcataccccatgccaaaagacatgtatgaaaaggggaggtatttacacggtaaacccgcttatccctccatgaatctcttcggcgtaccgcgcaacggcttcaatatgaccggatatctgttcaatcgaccggcaggatgaagcacaggcctctgcagatgacccggcatcccgtgctgtctccaccatcaaatcaccaattctccgtgcccgttcattcagatcgcgaatcctgctctcctgctcatgtgacagtatcccggtctcccggctcatggtagcgataacctcaacctctccggccatcttttcaaataaatgaaccatttcacatatggcatggcttctggactcaatctctccctgaacctgtgagaccttatcccgcacctcccggaaggcatcatgcaacgccgcaagcgtctgggaaatactggttgtggactcttttgactgcacagccagatgctttacctcacttgcaacaaccgcgaatccccttccatagcttccggcatgagccgcttcaattgctgcatttatggcaagtagatttgtctggtttgcaatgtccgtaactaccttgatgatcttctcaatgctgatcagctcttcatggatacgggaaatcccactgtccaccgacccggctgcatctgatatggcgtcaatcccttcacggctctgtgttgccagcaccactccctgcgatgacatctcatgcgttctggcagatgtctgggctacctcctgcaccttctcattcatcccgcaaagcgcctgcatggcagtatctgcactcataaccatctgcctgacctcatcctggacactgactgcccgttcagatacggcactggtgtaacaggcaagggtctcagcctgccctgaaaccgctgctatctcccgtttaatcccatcagactcttcagtcagcacatctgctgcatttctgagcaccgtgatactttcagatacctgaaccccgatattgtcaagcgaacttcggatggtagtgaaatcccccgtcacctcaagttttgaactcatatgggcggtaaagtcaccagatgcataccggctgcttacccggtcaatctccccgacaacagctgaacaccagatcccgatcgaatccatggactctttcatactggcaaaatctccgggatatgcaatcttctcatccatccgtgaggagaattcacaggctgcaaaggccttcgcaacccgtttcatctcaagaaggggcgtattgagtctgaccagcatctgattcattcctgcaatcatcgcctgataataaccggaaagacctgatgtttcccctttcacggtaagatttccctccataaccgacatcgtgaaggattcaacagttgcaatcatgagctgcagactatccagtgccccgttcagatcctgaatgataccggtaaacggaccttcctctggtgctgatatggagagcggaatccatcctgagttcatctgggagattccgtcagtcaatgcctgaaactgcagctgtacctgctccatcatggtatttaccgcctgaataccgggcttaagatcctccggacaggattctatctccatccggtatgagaaattccctgcagatatcgctgatgccagctgttccagtgcagaagaaagagcagaattgtcaggagtatctgccttatcattaaccggggatattagttcagttatggtcagaaacaggaccgaacgcttgaggagaaccacttcacagacccggaccgtaatcaggtatgcgacctctaatacggtattttcgtgaataaaccgaatctctgtcccgggatgattgtgaatgcccagtattgcaggatgctctgagagagcgtcccacttcaggatgttattattcagaagaacatcagccgggatgggaattgaggacccggaagatatggagaggatagtcccatccatctcggcgaggatctcacaggattcagaaagagacctcctgatcgtatcatatgagggaaagtccggcggattgtccggcttgataaagaacaccagcatgaccggaacagactggccttcaggcaccgtaggaagggcacgaacctcataaaaccctgcccctgtcggaaagacgacctccgctatccctgatgttatccgtccggagagagcagcatcccagaccgactcgccggagagaagagacaccgggaggtttttaaaatgcatccctttcattgtctcattctgaaacccggagatactgaggaaggcttcgtttgcatgtgaaatcgtcagagtgtgatcacagaggagaaccggaaccgggaatgcatcaatggaatcatcccagcatgaaaatgcatacgacccctgtgatatatgctgaataaacgaatccgccgcagcaccttgtcttgaaacaacagaattatgaatcatcggcatgcacctgccctgcaaaagaagtgtgtaaagcgttcatcagttcctcccctttgtaaaaccggtaacaactcttcggaatacatatctcaaacctggcaccttttccataggttccattctcagtaatgctcatcccggtcatccccagaatttcccgggtgtaaaaaagaccaagacctgaattccggcccactccccgttcaaagatgaccttctttttattatccggaatacccatcccgtcatcctcaatgatgagaaggccattatcaatcctctcaacaaaccgaatttgtattgcagaaacccggctcccgtgcatcagggcattttcaacaagattgatgactatctttccaaacatcgggtcggtatacacctcaagcgtcccggtggaatggaggatggagacattgccaaatccatgagactgggtaatattctcgatgatacgggagatagaaagccactggggtttttgaataccaatcttctggtatacatcggagaacatcagatgttcctggatattattaagagaaatccccaattcttttacatcaggcgcaatctccggatacttgtgcgaaagttcaagcagattatcataatgaaagagctgggcggtcagttcattcctgatatcgtgccgggttatcgtattgaggatatcgagttttttattcgtcccaatcagattttccatctcgttatgctcttcctggaggagaaagtgatgaagagcgtatgatatctcccgtgcaacatcctgcaccatcgcctgttcgtcaggatcccgggcatattcaggctcgagagtcacagatacaatgccaaagaccgttcctgcatgttccagtctgaccgtcagggtatgggcatcatgatgacctgagtagagcgggcataatacgcaggtctcatcaggagcacaaataaccgggccactcctgctttgcagtgccttcttgtaacaggatgtccggttccctgcctgaagatacgagaggaaccggcccatctgctcttcaagaccggcatgatacaccccggtcacattcccatttgcatcaaacaggacgatacgcatgttctgatatccgggttcagaggtaatcctgctgcagagacgggcaaaaacctcttctctcctttcattcccatgaatggtgtcagatacctcccgaagaacctgaaatatccgggagagatgcctgagtttttgctgatcccggtactgccggtatgccttcatgaccttatcagatagttctgcatactgtgaacgaggctctcctcccttttgtacgtaaaaggtggctcctgaattgattgctgataccgcaacactttctcttccccggccggtaaaaagaataaaaggaatatcacatccatgacctctgattgtttgcaaaagctcaattccactcatgtccggcatttcatagtcggagatgaagacatcaaccgaatacacagtcagatgttcaaatgcctcctgtaccgatgaacatgaatagacccggatatgaccggagcgttcaagaaacgccttggtgacctccagaatatggacatcatcatcgacatggaggacgtggactggaaacaggtgaggtaatgagtggtacattgggatcaccccagtttcccgatcttgtctgcaagttcctgggccagatcctgctctatgaacatggctgaagcaagaccaacccatttcgccagttccttacagtgttcagggccgatatcgggaaaattcagaccctgaagatgaaactttgtctgtcgttccaggagggtgattgctgcaggaccgagatattcaaccgcaatctcaagcactgcatcagaggttttgctcataaaaatcccccgtctaccagttactcatgctggtagtcctggtgcatcaggatcttcagactggtaatcatccgtttgaatgatgaagcaagttctccaatctcatcgttccgattaattgagatagacacattcgtatcccctctgctgatcttatttgccgattctatcagcatgtgaatgtcacggatcatggtccgggagaatatggcaataataagtccagcacagagaatgccaaggaacagaatcagataaatggtctgaccaacaaagtccatccggttctgtacaaccgctgcatccatatccacaccaacaataccaataacctcccccctggcattcttaatcggtgcatacccggcaagtacagtcccccagggcctctcaacaaagtctttttcaacagagggaccagtaaatgctgatatcatggcaggtgtcggatttgagacgggattgccaatttttacatcccttttcccgatattatacccgctgtctatgacatattccatcccgtcaccctgttttctggcggtgaaaatcttcacgatctcatgatcagcctgggacatatgggccagttgttcagcattcatcagatagaggatttcagcctccattccaggttttaatttggcgatctcatctccgttcaggtctgctgcagtgagagaggcaagagccaccagctcctgctgagttgattcctgaattttatcagtcgatgcaccgacggtaaacaaaaatgtaagtccggtaataagaattaccagaataacaaaaccggcggtgagttttgtcataattgagtgcagcatatctgccatagaattattctctccaaaaatttccgaatcacaggccggaaaacatccggtcaggatcggaatgtatgcatataagatcatgtgccggttcgataatgattcggcatagagtctattggtcgatatagtgagaatagagaactataaagacatcatattcctcatgagtacccatatctctctatattctctatcggaaacggggataatacagggatgacaatggatgacgggatttatcatgtctcatacaatgaaaactccggttctccggatggcaggaatcatattcctgctctgtgctgtcttctgtgccactgcccccgttatggctgaagagacgacgttaagtatctcaggctcaacaaccgttcttccgatcgcctctgcatgtgcagaagcattcatggatgcccaccctgatgttgatgttcaggttagtggcgggggatctggtgctggtatcaaggcaataggcgaaggtgttgtcagccttgcaatggcatcccgtgaactgaaagacgaagagaagaccaaataccccaatcttcagaccgttgcagtcgcaaaggatggtattgcagtcattgtaaaccctgaaaacgccgtagaagcacttactctgaaacagatcaaggacatctacaccgggaccatcaccggatggcaggatgttggcggagagaccgcaaagattgagatcgtcggacgtgacagtgcatcaggaaccagagagttcttccttgagagagtcctcaacaaggaagacttcaccaagttcatgcttgaaaagaactccaatggtgcggtccagcagtacgtatcccagaccccgaccgcaatcggatacgtcggtatgggctttgaagatggcgtaaaggtcattgagatcacgggcgacgatggaaagaattcaaaaccatcagtcgagaccgtaaagtccggtgcatacccactctcccgtgaattatacttcgttaccgccggtgagccggaaggccttgcaaaagagttccttgactttgtcctgagcgctgaaggacagaagattgtcgaagaacagggctttgtaagcatctaaaagaatcataaaggattacaatccgaggagagataattctctccgttcctgttcttcagttcttctattctacatccggcgttacatcggtatcaattcttccatcaacaaacctgatgacccggtcaaagtactcctcatgccagggctcatgggaaaccatcacgatagtttgtccatgctcccggttcagacgttgaaacaggtcaagaaccattcgtgaagaagcagtatcaagattggcacacggctcatcggcaaatacgattgcaggttcattcatcagggctcgtgcaatcgctacccgttgctgctgaccgccggagagctcacgcttcaggtgatgagcccggcctgaaagaccaacctcttcagtaagtctcatagcccgatccatcacctgataataatccattcccagaccaaaacccggcacagcgatattttctacaaccgtcagatcctctatgagagcatagtcctgaaagacataccccatggtttcgagtcgaaaccgggatcgtttttcattggaaagcaaagagacgtctgttccggaaatcagaacctttcctgagctctgggagtcaagcaatccgatgagatggagaaatgtggactttccacttccggatggccccataactcccacaaactctcctttctctatcctaaccgaaatcccccgtaatgcatgaacgctgacatcacccatcgcataggtttttcgaaggtcgcaggtctcaatcatcggttcaccagatccagaatatcttcagatgttgcctgcttagcaggaataaaaccggctatcagggaaacgaacccaagaaccataagagaaggaagaaggacagtcagatcaaacaccggatacactgcaccggccggaaactgaagaggaaaagccctgaaatattcactcagacacgtaaagagtgccaccccgcagagagcaccacatccatagatgacggccacctgaaccaggtagtccctgattatatcccgttcaggaataccaatggccttgagaatgcctatctgtcttctttgatgggttgtgttgatgtatactacaataaatatgacaatgcttgcaataacgagggaaaagaccagcatgattgaattcaggagggagaaactcttcaatgcgtcaccaattatcccttctcctttttcggttaccgtcttgatgtcatcacgaattccaaactccataagccgtatcttggtctgagcaagggtctctgcaccagatgagcggatgagaatgagagacgatttgtcagtcggtccaagtactgattccatctctttttgtgtgatgaatgcttcattatcagcagagatggagcctgtctcaaatatccctgccacggtcattttcctgacaatgccgttctgaaatgtaacttttagtgaatcaccggcatgaaccccgcccagcgattccattttatcctttttttcatcatcatgaccggcaagcactgaaccgagcagaatcacatcagtgtctccatcagagagataccgaccttcagttatcttcccaaaggtctttgtgacacgttcttcatcagacgggataattgcgacaaccccccgtgatagaatctttttatccgattccaacgaagtactgacgatcatatgtgacgaggttgcagcgataccgggagtccgctcgatggttctgaccagcatatgagtatctgatagaacctgattatcatcatccggttcgataatcaggtcagcatactggtaatcactgacctgctgattatatgccccggtaagtcctgcggtaagggatggcataaagaccattaaaacaaaggataatgccacgatcatgatagtaaggagaaatgtccccttattccccctttgtattgcacgaacagccagataaaccggaatattaaccgtcttcataccgtaggctccgactgccggcgacgatattccacgataccaccaccgatgagacacaggataataacggccggaatgagcagtggatttcccctgggcgcaatagtcagcgaaagagtatcatccatgacatattccgtcccttcatgttccatcctgatcattatcgggatctgataatccccggcgggagcttcctgaagatagaataccgcagggccgtcattatccggttcaatcttcccgacaaaggcctcttttgtcccttttaccggggcatcgattactgccctgactccatttgcatccccggtccccgtgttctcaatccggacgatgagcgagaagggcattccttccgatatccggaccggatctgaagttactgctgcaatggcaagatccggtttcccggaaattttaaccggcacctgttcggtctgtgtcaggatcgtccctcctgcggtactatacctgagggtgcagacaaggagcgatattccctctggtgtcttccggctcgttgagatcgtaagagggatgctcacatcctcacctggtccaaggcgggatatatgggttataaccttgctggctacagagatttcagggcttgccgggctgatattcaccataatttctgatgcagccgtatcaccgtcattttggagaataagagtcccttctgcattttcaccaggtattaccgagtcaggaatctcttttgttatctggagggcaggattcttctgtaccaggctgtcatcattgacattcaccggtatcgggtatttcaggctccttcctccttcggttgcgatatgcagctctggaaagtagattcctgattgatgcggagcctgcaccaggaatgtcaggggtactgactgcccaggaccaacctctccgacccggcggtaatctccggactccacccgaagcccgtttccaaagagggagacatctgataggtagacattgatatccctcgtctcggttaccgactgcccggttgtctgatctccaccggttttcgttaccgatgcaccttttgcggtgtttgatacctggacggtaatgagagcagagcctccgggcatgatcacgtcaggtctgacctcatacgaggagattacaatggtcggttcacttgcggtcacaattcccgtaagtccgatccccgccagaatgataaggaaagatatgaggatgcagacctttcggtaatgaacagtttctgtttttagccggtatgaaaggagagataccggacatgctgacatttgcgtcatttataataacatagatgtcattatactgacataaatgttactgacgaacgtgtcattatattatctcacaaccaacattctcctatgcctcgggtagtcccggaatataaaaaagaagcaaagaaacgaatactggaggttgccacccggatagtttttgaaaaagggtaccagcatgtgcggatggatgatattgcgaaggaagcaggaatctccagacccaccctctacctctattatgaaaataaagaagccctctttcttgagatcatcaaatccatcatcgccgatgtcagttctatggcacaagagtccatacagtcaggtgagatccagtcccttggagatttttttgcagaggccaataaccagtataggaaccagtttgcgatgatctttgaggtcatggcaggactcccaaaaaaacaccggttaatttcagagattgccctgcttcatgacgagatgatacatcagatcgctatgtacctttcgatgcggtttcctgaccggccagtggaaattgacccggaaattatggcaaatgctatgcttgccctgtttattggtctgcagataaggcaaagactcggtcttgatccggagaaagcagcacgagtatgggaaacagtaatatcagccccgtttcaaattagcagaacttaccgagtctaaacccctacgaagagaacatgaccgaccaggccgatcttatccttcgaacactcactcccggtgaggatatcccatataatctcctcttactcgctgatgagacaaattatgaagatgcgatctcccggagttattatgccttgtattatgcagccaaagctctgctctcttcaaaagggattattacaaaaacccacaaaggactcattactcaaatcagtgaccattatgtgaacaatggtcttgtggatcatcagatctggcatactctggcctataccgaatccttaagagaatcagcagattatagtaccggagaacaaatcacagaggaaatatcactagatgttatcgaagagagtaaaaaaaattcattcaggtatgcgaaattctggttttacgacaaagataagtttaacaataagttcatgatcccagaaaaaaataggggtgggtatcaacaatacacttttacctcccctatcccctccccttccccaccttacggattactctccacaagccggacaggattcactgcttcagtcggcatccgaccgccaaacccccagggtcccttgtacaccccgtccggagcgagatccctatcatgttccttcagccagtaaaactgatggtggtatacatacacccctttcgtgttggaatccctccgctccaccagctcatgcccgataagtttcccaaactgttgaaatttctttcccatcgttttcaccggaaaccgggaagaaagactgatgtagagtgtttttcgaagatacgaataattcagtggattatcaagccaggtaatcatagtggattctccttttcatacagatatttcatttcatccaggtgtttctgacagacctggttatacggccgatccgggatccaaaacatcgctgatgaccgggttgaagcggtgcatcccttgcacctgcagtataattctgttcggtcctcatccggaataggaacatatgcatggaccggaaggtcaggactcataccatgatatacagcaaattcctggaagatggtaaactctgacagggctcgcgatgtgtcttcgtgggcaggctgcaccagaccatctccaggctgagagaatctttgtgcatcgccaccattcggtttattaaacgattcaataccagccatttcagtttggagaacctgatattcagggcctctcaggcattccggacaatcggggatctctccaccagactcatcataataataccgttgcataatctccagccatttccttctggttggaatctccagagcccggatattttttatcccatgtgcagtctgaacccgcttctgtctgctcaccataccgatgcctccaagagcccgggagacactttttgaactgcacttcagaccttcggtaatcattttggaggtaaccgcctgaattcgtccttcatagtaatatttaccaaattctggatcgctgatcaggatttcatcgcccaatgccagggaaagaacataattgaacataataccttcatacgattcagcccgtgtccgcttgatctcctcctgccggcttttgaggtaccgtaaaaaccgctcctgcccgtcaggaaagagagtcagaataatggagagaggtcgtgccatctgcttgagtcgtccttctattccgtttcctatacaggagagcatgcattcttctgaaacacggggccagtgctcaagagtaaacctggcaataagagcccttattaccgctacctcctctgcatacgtggatggaagttcaggaggaatatcatcccgtgtggtctcatccggagagaaggaaagacaccgcccctcggttgcggtatcctggaacggctgtctcatggcgatgagtttgggaccaaacggatcaaagagatgaaccctcgaaacgtcgtttttatcggtcaggatgaagaaattatccttttcaaatccgagattcaggtacttgataaggggagatgactgatcacctttcagatctgattcatcaatcagaagtgttcccatccatttctctttaaatcgcatgatgccggagattgaagacgcccctgatgcccggattggatagaaacaaagatcagagataacttttaaaaaccggctctttcctttcccggtatcaccaaggaaccggagatagggcgtggtgctgcattttgagtaataccaggagtacaggatatagtagacaaataactcataatcatgctcgtcagcatccaggtatctgaacaaatgatccctgattcgggcatataatgcaccgggtgtcaaaagttctgccttttccaaaagatcagtccgtggaattccgacaatataactggtcgtaccccgatcctgatgaacggggagctccggaggcatcgtgactatcccggacggatcggtctcttcgcttgaaaataccacggtgccatcctgcaggtgagcatatgaataccggacatccggactgatacaggtaaggtagaggaccccgtctttctcaaaaaagggaatatgcctgattacctcctcttcttccggggtatcaaacaatttcacggttttgatataggaatatgccagatccttgatctccgaaagagccccataatccagtcgttgatactctttcagcttcttattccggttctgcagggttttaataactgcatcggagggttttcggttggagagcagatagacagcaatatcccagaactcctgtctcatatctccttcttcaggaggatccatggtgaaaaggtatgcaccggattcttttacctttgaataggagcggtctcctgccatacctaaagctcttctcatcgtatcagtgaagggggaatgaattgtcattacttcggtcatgatctcctccgtgatctcttccaggcaatccgttctaaaaacctgacttcaggcttttcccgatccagcacctccagatgccgtctcatcacatccgaatcatatgtcccgccacaggacataattccccggcatatggcatcccaaccggctgcatcatacccggcagcacaccggaaacagtagacaacgcctttgtaagggttcatcgccacatttcctcctggtgacgtgctcccatgaaccggatgcactccccggatctcgcttcccgctatcctggcatcccgtgggaggttgtccatgacagagagaccataccgctcggtaattgtctttcctctgctttgtacaggggcatgagattccggttcagggatcgaatcagcgagagccgggcttatgattctggcgatattctcaatttcagaccatctgacggtcattatggacgcatcaggatcatatatttcataccggttcccattcggatgcagagagccaggtccgatacactgaccaccggttttctccattccagccgggaagaagagttcaacgatggtatggtccagaacgttacggatcgagagtttgtgcccccggaagtgagcaggaatatccggacaggagacgatggcccggtatttatgccagtcaggccatgctgaataccggaatgtctccctgaccagatccttcccgcctgctgcatgaaatgtccctctatcatccacgtcaagagagaggatatctgaaccgggagcaggataatacccataattcccaccatgttgcagatgtacggccagaatgggatcatcagaccgcctcccctgtgataccaggttccagcccttgtacgtcgggcccttctccccggccggaaccatgacatagagcaggtcttcacgctgcatctgcctgggtataccagagccatggggtacagaggttgttgttttactcattgagtccccctctggaccccacagcatcaaggatgtcatgaatccagttcaaagatagttcatcagatcgtttttgattaatactgggatcttccattttttctcaatcctgtcgatattagcgttttcccataacggcgatcgtggaaaagaacacatgtgtgctcatttctctctactctcgttatccgtgcttccatataagcattggtattataatactatgtattaattcatagcaatatattcatagtaataagttcatatacataggtcatgactgaagggagaacgcggggtcagggcaacaatccaggggttacgaaacgaaagattatcgagattatcttaaagcaatctgaacctaccccggaaccattgattcgggacagtattgccagcgatcttggaataaaagaaccaaagagtacaaagatacaactcgccgctgcaaaggaagaagggattctcctgaaagatacaagaagcggcgtgaattactgggatattgattttacttctgaagctcttcttggatatgtcattgacatcatcaccctgatgccggggaaggatcgggtcccgttcttctcctctttatatgttcaggacctggtactgaaaatggcagggtttttggcacggacaaatcatccaaaaacacgggtcggatattacagcacaaaattatctgaatactggggctttttgaagagtgagccgattcatgagactttggatgaagaattaccagatgacgttctccgggccgtgcggttttaccaatgggtggtaacccgctcgccatcctttttcctgtattcatttcaggatgcagcccaaatcgatccgttcctcgaatctatccttgcatcatacatacacaaggctgaatggagagattttgatctcctctattttgtcgggacgatggggctcattatcgattacagcagggcagatgagcgataccgggatgaaatagcagcattcctgggagagaattcacgcgatatcttcaatcacacatccataaaatatcccgaccggttattccggaatatgatacaggcacatgagatgatgcaagagaggcataccattcccaccactcaagggggttcccagaaagcatttcgaacgaatttgaatatgtttgagaaattatagggatttaacgaaaagaaggcattgtagcagttgtaacacttgtagcagctctatggaaaagagacctgaatagtttttcatcagtatctgatctgaatccgggtctgaacatgcagaatatctggaaaatatggacgggtctgaattcatagattcagacgagcgattaatagaccatacctggatcgattacaaccccttctttgaaaatgccctgattacctcttcacaaacaccaaaggcatcacattctgatatctgcatgtaataataattatgtccatgttcgttaatattcgctcgaaaaccctggctatcccagttttgctgaataccctcccgaaactcacctgccggtaatgtatcgctggcacagagttgttgcaggtgtctgacttcgtgagctaccgttccaataaggacagcaggatctttccaaatctctgaatcaggtcttatgaggatggtcttatcactgtcaataaaagctgcctcctctccaggattcagttcttcttcatctgcaaaccgaacttcattgagatattctttgtcaaatttaagagcttcaattatcgcattcgcgattatatttgcaaattctttcttttctttgaggtcccttggttcatccttccatgaatctaattttttttgtacttcgggatcttttgttatggtatcatagattttttgagctacccggagatgctcaccttctggaataggggttccaaatatcggatatgcactctctatttgcacccagttcctatcccagttatttttatcgggatttttttcaaaatattgcacaggtattgggtcatcgtccggatatctcatagaatatacgaaatttccatctgggcttatagaccagtcatctgggtacttatcagagcccttcaaatttttattcaaagatgaaataactgcatttgcagcgtttttcaatgaattctgtacatccagtcccttattttcttcttttctctcttttttatcagcattgtgttctatttcaggggttttttcaatatcttcttttttgtcaggttcagcggattgtgtattagtatttaaataataattaagagaaatatcattattatttaggttttccgaatcccttttttcaatatctgtctgtacatcatgggtttgggatttttctgatatcatctcatccaatgatggattttcatcaggcgaagatattgtattggaatggtctttttctttaacaagatctggattttcgtttatcagagtatttttaatctcattccatcttcgctccaattcttcctctgaatacgttgactgggtagttacgtacccaaactcattgagataaaagacggtcttggttttcggatcatagaactgatttgtcttttcgtcaatgattatctcatcagatgcttttgattcattcacatgaacatccggaatttctgtgggctttggggtacttgtcaatggagggtatttatcgttatcaacgtcataatcacagaccccattcccatcaaggtcaatgtaatccttgcagatgtgtggtgagttatgaaaacaggttgctgctgaggtgggaacactccacagaagagatagaatgagagataaacaaatgagtgcaagaaaggaagactcactctcattgttgcaggatcaaaaaagtctatcgtctatctctggatggtatatccatcagagatcatggagaaagtatatcaatcactcatgaatgatatggctacatcgttaaaaatattttaattttttatgcaaaattttttccggatttgttcgatttagcgtgtcaatccctctttgttttcgtgttctctctgtcggtatgtgaatgccatccctgtgtcgtgggggaggaaatcatacaacctggtgattggaaggggatgtacctgctatttttcaatatccatcagtatccagcacttcatcgaattcctcacaccgaaattttttaccagggtctcttttccatagaactgctacaactgttacaactgttacacgggcgttaaattggataaaaatgctttaatgctccaataatgattaaaagtgataattccgctcaatactgaggaaggggctcgattagtcaacctttttatataatgaattgtggagacagtgttgccacaattatgaatcatgagattatttctccccataaacggtttttgcaccttttggagacacgaatgggataagataaaaaggatacccagatttacaaatttttccggggtgtcttccataagtagatacttactattcaataaatcatagatattaagaaattatgagcgataacctgatgagttaccattgcatataataggtaaggaggaactgggatgttaaggacatataaggcgattataagaaataattatgttgaatgggataacgacattcatgaagtaataaactcagataatcctgtttcagtgtatattactattttagatgaacccaaaccagataataataccgaaagaggcaaatgtatggtttcagctttgaacaagttagttaaaataaaagcatttggcgatgttgatgatcctgttgagttcatacgagagatgaggcaggagagagagctaccgggaagacaagatgctgattgatagtaatataatcatttatgccatgcatcccgataaggaaattgtccgtaaattaattgagaagaattcaccctttgtctccgttgtcagttatgtcgaggtactcggatatcataaattatgtgaaatggaacgggaatatctcgaagattttttcaaaaatgcgaaaatgttaccgatttctcaaagcgttttagattatgcagtaaaactcaggcaaataagaaaaatgacattgggagatgctctcattgctggcactgcactaactcatgatattaaattagttaccagaaatattaccgactttcaatggattgagaacctagagttaattaatccatttgaatagattattgcatttattgtagatttagttcctttcatcgtagtgtatgttggataaaatataagatcagtaaccctcccaccagaatacctacaattatttgtgcaggtctcttttccatagaactgctacaaccgctacaactgttacacgggcgttaaatctgataaggatagctcaatgcaaccataatgctgaaaggtgataattccgctcaatactgagggaggggctcgattagtcaacctttttatataatgaattgtggagacagtgttgccacaattatacttgaaaggatagatctcgtcatagagaaatttttgctccattaggtgacacgaatctgaaaagatgaaaagagtaattatttataagtttaatttctcttactataaaaaaatgctgccatgaaaacggtacaatttatgggattttaatttatcaataaaaacatttttctatgtctatcattatagaacttatatcgtacaatcatattaccatccgcgttttcaatagcacctccaatttctctccaatccagataccatgaccgtgaaccagaatcctgaacagatagccagggacaccatcgaccggaaattaaatgaatccgggttcgcggttcagcatagaaaacatatcgactggaaggtattttccggtattgcggtcagtgagtatccgaccgatgctctgcctgctgattatgttctgtttgtggacctgattcctgttggggctaatgaagcggtataagaattaagagcacaataaagggtacaggatttagacagccatataaggggattacagagtatatcatgccacaacttgaactcatcgaagcaatcgagagacgcctctggaaatcggcggataatcttcgtgcaaactccaactttgccagtaacgagtacttccttcccgtgatgggtcttatcttccttcgtcatgcatacagtcggtatctcatggtgaaggatgagatagagaagacccttccaaagcgtggcggaaaaacccgtgctctcacgaaggaggatttctcccagaagagtgctatttatctccggccacaagcccagtatgattacctggtctctcttccggatagcagtgaccgtgcgggtgcaatcattgcggcgatggaatcgatagaggaggattatgatcttgaaggtgtactgccaaaggaagaataccgtgctcttgagaatgatgtcctgaaacagactcttcagatcttaaacccggacgaactgaaacaagcttccggagatgtgttcggcaggatatatgagtactttcttacccagtttgccgacctcaaagcccacgacaacggagaatttttcaccccggtatctctggtatcactcatcgccaatatcatagaaccgaaagaaggtattgtgcttgatccggcctgtggttccggaggtatgtttgtccagagtgctcattttgtagaacggctgaaccagagtccgactgaacatctgaccttcaaagggatggagaagaatgcaacgaccatccggcttgcgaagatgaacctgaccgttcatggtctggaaggagatatcatgaaagcgatcacctattatcaggatcctcatgaactctttcagaaagcggattatgtgatggcaaatcctccgttcaatgttgacgaagtggatgccgataaggtaaagaacgatccccgtcttccgtttggtctccccggagttaataatcaggataaagtctcgaatgggaactatctctggatcagttacttttacagttacctgaatgagaagggccgggccgggtttgtgatgtcttcccaggcatcaagtgcaggtagggacgaagcaaaagtcaggcagaaacttgtggagaccggagcggttgaaatcatggtctctatcagatcaaacttcttttacacccgtacggttccctgtgaactctgatttttaaacaaggccaagccggaagaaatgaaggattcggtcctgatgatcgatgcccggaatatcttccgaaaggtaacacggaagatctatgatttcagtcctgagcaggaacagaatattcttgcgatcgtctggctgtaccggggtgagacagggcgatacctggaacttgtatcccggtactgtgagacgatgctgagagaggctgaatcatcggtcaattccggagatgagaaccttttcaatcagttctgccagaagatgactctgtttttagacaccgcccggccccatatcatcagactttcgggggattatgcagcaaaagagatcttctccgagcttgaaggagagaacgcccagttatctaaagagattaacggatttgcgaagggtacatctcatgaactgaaactctgggagaagcaggatacctcaaacggggggctaaagaaagcagttgaccggctttcttctcttccggatagcagtcatgcactggtaacccaggtagatctgatatcaaaacttgcaaaccggcttatggagacgtgtgagaaggagggtcaggcaaaggggtctgatctctggtcaggtcgggatttgaacaggattctgaaagatgctgaaggtgtcagggaggaactaattttcgatctgaaacaggtcagatacttttggaaacaggctcactggctggttgagcggttcccggacggaacataccgggatgtggagggtctggtaaagcgggtctcccggtcagagattgcagcaaatgactggagtcttactccggggaggtatgtgggagttgctccggaagaggtggatgaggagtttgactttgaagaggctctccgggatattcatatcgaactggaaggcctgaatgcagaggctgtagaacttgccgggataatacagaagaactttaaggaacttgggatatgaccgtggttctgactgacgaagagataaagtcccttatcggtgaagagaaaagaatcccaccggactttttcccgacatttcatcttgtcagaaagggcggccacagggaagggaaaaaggatctctctggtagtcagggcaaccattttcgcgtgattgttcgtcaggggtgctttaatcacctagacttttccattggtcttttatattttccaaaaaattctaacaaagcgtttatcctgaagaaatataatggaaagagtcatcagcatacaaataagattgaaaaagaaacattctatgatttccacattcacaccgccactgaacgataccaggaagaggggatagactgtgaagacggatatgcaattgtctccgaccgatattgtgagattaccggagcaatgagatgcatggaagaagattgtggatttgttatccagacagataatgtaactcttgatgtattcggggtgaataatgacgagtgatgtaatcctccagtctttcaggcagaccgtctgccatgatctgactcttgtacctgaaggtattgagaggtaccgggttttttctccgtttatgttccatgatggagatcaccttgccctcgttctgaaacgggaagaatccggatgggttttgagtgatgaaggtcacacgatgatgcatctgtcataccggatggagtataaggacctgacacaggggaaaagaggggagataatagattcaattctggcgaaacatggtattcgtgaccgtgatggagagtttatctgcccggttcctgatacccagtatggagacgccctgtttcagatggtgcagggacttttgcgagtgagtgatatatcattcttatcacgggaacatgtcagatctaccttccgtgatgatgtttcagcatatataaatgcattacccggtctctccggacaggtaacctgggaatggcatgatccagttcatgatccggaaggaatgtaccctgccgatgggtatcttacgggtttagatgagcctaccgtcctgttcctgctccagaatgatgaccgggttcgggatgcaaccataaaccttcttcagtatgaaaagtggggggtcccggttcattcggttgcaatatttgagaaccaggaaatgattaaccggaaagcactggcaaaactttcagatgtctgtgataagatgttctcgaactttaccggaaacaaggacaggattcgtcagtacctggtacatgtatagaaatgattggtatgggttatctgatggggatgtcctgtagttctatttttggtaatggtttatcaagatctgacttctccgagttggattatgagaaatgtttgaatgatccaattgtggagtcagtgactccactattttcatttgaaggaacggtctttatctcccgatatttccttgagttgccgaagaaagaggaggtagagaggtttattgaaaggcagattcggggaagggtatgagatgattgtttcgtgttacgtataaaaatctttgtgagttagatgccacaaatgaaaacaaattgcttaaagggatggaaaaaagtgcccttatgcgatattgctaatattacaatgggtcaaagtccaccgtcggaatattataataatgaaaatttaggtttacctttttttcaaggtgtaacaaattttggagaccgttaccccaaagttactatttattgtacaaaagagcaaaaagtagctaatcctggagatatcttatttagtgtaagggcaccagttgggcggataaatctcgcccctgaaaaattgataattggaacctcacctcccgaaaacctttaggcgcatagacttaatacagtcaaaatttctctatttttcttactgactttagattgaataatctctccctgagatagtacaaaaagtttaaccccctccgataatccgcggtgtacaaagaagattttagaattatttcactattcgcgcggctgataaacttggattgtaaaagtgcaatgcgaattcaatccttttaagaattaagaaacaaaccgaaagatcaaagataaaagagggagaattctatttgataattttgaaaactcccataatagtagacacttctgatcataaatggattttgctgaagaaaattctaggtgttttagagacacgcagatgccgccaagaaattgcaaaatttgggataaaaccagcaaatcaggcttacacgaatttagctatcttattgctgtcaatgtttttttcagtagaaatttcctatgcaataacggaaattgaaaaaagaatagaattgcagcaatttttacgaatagataatattcctacccctaacggtgtttatcgtttcatgagtcaattttctgcagagcaatttatttcaatgactcatggtattttaaacgcagtttgccccaagaaacgacattattttcgaaaaacaataatcattgatgggacatcgctgtctgtagatataaattggttcagaaaacgcattcaaaaatcaaagttagtaaataaaccctataattggcaatattctccttctaagggattttatattggtttaaaattaacacttgcgatcgatcagaataatcttcttcccttagcgtttcttgttcatcagaatccagtcgctgattcaaaaatattcccgttaattcttcaagaattgaaacggaggaggattttaaacaaaggagatagagtgttactcgatcgtgggtactattcttacaaaaattatgtattatcattgatagaatacagtgtaattcctttaattcttccgaaaaaaggattttaagtgggatcccatccttcagaaaggcatgaataaacggcctgatagaatcggaaactcccgctttttctgctgaagtcgtcatctttttatacttgtacaaagtaggatccatcataaagacttcagaatccaaggcggtgatcatgagccatcacctgactcttcatgcatctttcgtagttttacgaaaaaacgggttgattcatacgtactgaaacggttcttataaatggatttcttgagccatttaatcgcctccatttttttgtttaaccgttacaataatgatatgtatggaagatcgcggttctgtttctccgcaagacggtgtgcaaatgcaatcgcctcatcacctcttcccgaccgctcaagtgccatctctatccagtctgcattgtccaacaagtcagcatctgaagaggacccgatcgtattcttcccttctttgtccttcccaaacagactgtcagctacctttgaccattcagattcagggtgtgagcgattgataaaaccccgaatatcatcggtcagatcgtactcatcttccctgattaactcaatcgcagacaaaaccttctgatggaccggaagatccgagagttcgaatgcttttgcaacaacctccatacaatccgaaatttgagaactgattgaacctgattcatcatccatctcaagctgagcagcggctttttcaaggaggaaccgaccaaggtggataagatcagcatatcgcttcgcctcaagcaaagcggagaaactctcatagataccggagtaatccggcatatcctcttcatccatctcataccagtcagaataggagacctcctctgaggttaccagttcaatttcagcaattaccgccgataacgatgaatcggatgaactctcctcaattctctgtcgccggtcaagggacaccccaatatcatgcccctcaagcccggaaaggatgatagatatcagttcgtctttgagagcgactgtaaatacgctgtcatgtctttcgttcggttatgaataaccggagcaggaagaagaaattccttcgatcccgaatcaagaagcgtatgatatgtccgctcatactccttttcaggaggttttgatacctcaataccccgttttaaccgctcgagatactccagcatcaatgcaacgccatgtttacagtccaaccccaccggacaggtacatctcgaggagagactatctgatactgatactgatactaccgtatcatactctttggtcccctctaccgacccgcagataatatcgtcagagatctgatatacgcttgatacatgcccggatctttgatatgatctccctcttgaagccgtctgttgtctcacccaggagttcagatcatgataggagagatccctgaactgttataataaagagctctcccctggagcatatcaacggatggatcgatacgatcaatcccattatgtgagcagaaggagactatgtatgcacatctgaggagccctgagtgaccgcgaaacgaccagcaccaatccacgataaagaagaagagaccatacccgatacttcgcttccggtctttcatgccctgatttacccggccgttgaaggggtagcgatatgtgccgaatatataactgataaacctgcaccggtcaggaaaaaaggctacgcaaaggataaacctggcgaatatccatattccctggatcataccgcccttaaaacgctcatagagaactgttttggagcatatgatgacctgaaggctaccagatggattatctatctccccgctgaagaaacggttcctccttcctctcagttctcatcaaaaaagaagccatcaccaaaggagaaaaaactcccccttgttccgatgtatatccccgttcttctctgcccgtatgaaaccttttttcaaatctggaaagccgctcagaatacagataaaaattatattgctggcgattccttccagtacatctccattctgatggagagtaccgtccggctcatacaaaacggacggttcaaaccatctctagaacggacctttgccggatatcatgccgtatgggtacctgccctttctcctcaggatatggaatgggtatcagatttttcaagccggatgccaacggtctgcaagtacgctatcccccgggtcgcaaaagatccctacatttataaacctgagaccagattagagaaattcatcgttgagatgatgcgggtgatcatccgtactgcccttggtggttatacactgaaagaagagacagatcccttttatgaaccctcagaaaacgagatgcagttcatgactgaccttctcggggtaaccgacccaataaggaacaaaggatttgagagaactttcttacgggcgatgcaggactggctgaccttctcaagttcaggacggtttgctccctttgagttctgcatgatcataaaagatccaccagaaggacagacagaaccatgggatttcactctcgcggtcagatcagaggcagaaccatctcttctcatcccggcagaaataatctgggaattgcctgatcaccagagcgggctcttcccccaggcagcctatctcaaacatatcctccttgctggtatcgggctcttgacctcatcatcatcggcattatggcgtcccctgtccggatcgaaacccaccgggggaagtatgaccctgaaagaggctgcaacgttcttgggttcagacctcgcaagagccaggaggaagggagtaacggtgctcctgccagactggtggactgatacgacctatacaccacgggttgaaatccatgcaaggcggcgggatcccacccatacgcagacacggataggactgcaggaactcctttcttttgattaccggattgcaatcggtgatgagtcattttcaccggatgagttctgggaaaaggtaaaagaaaaggctccctttatctggctggggaaccggtggatatcctttcatccggatgcgatacaacatgccctggattctttcagcaggcatcagagcaaaggaggggatacaataggagatctgctccggctctccctgaaaaaaatggaggattccgcggtaccggtatcgattcatgcaaaagatgactgggttgcggatcttctggattttttcaggaccgaaacaaatcaggcagttccagtcccaaagaaatttaaagggatactcaggccataccaggaagaggggttctccttcctttgtcaatgtaccagaaggggctttggagcctgccttgcagatgacatggggcttggaaaaactccccagacacttgcatggctggtctatctcaaggagaaagaaaaacccacgactccgtccctccttatatgcccgatgtcggttgttgggaactgggagcgggagatacagcggtttgcgccatcactccgttcatgggtgcatcatgggactgaccgatgcaaaggcgatgattttgtgagacatgtcggttcatatgacctggtcctgaccacctatcatctggcagcacgggacgtagaccacctcaaaaccgttccctggtctgcaatcattcttgacgaggcacaaaatatcaagaacctccatgcaaaccagaccgtagcagtcaaatctctcaccggtgagagacgggttgctctgaccggaaccccggtggagaaccggttactcgaactctggtctatcatggactttttaaatccaggataccttggttcacagagtgcatttacaaaccgctattcccgcccgattgagcaggaaaaaaatacggaactgatacaggaattaaggtccctcatccgtccgttcctgctcaggcggatgaaaacagacaagcatgttatcgatgatcttccggaaaagatggagaaccgggtatattgcaccctcacacccgaacaggcaaccttatatcaggctgttgtgcttgatatggcaaagaaccttgataaagtggagggtattgccaggaaaggggcaatccttgctgcgatcacacgactgaaacagatctgtaaccatccgggacgtgttggcagggataaaacaataaaggctgagcggtccgggaaggtgagccggctgcttgagatgattgaggagatcacttccgaaggggactcagcactcatattcagtcagtatgcaacatttgctgaggaactggcagggatgatagagaaacagggagatacgcccgttcttctcctgaccgggtcaacaccacggaaaaaacgggaacagatgatagaggagtttcaggcctcaaccaccccgataatctttgttatttctctgaaagccgggggaacgggtctgaacctgacgaaagcgactcatgtgtttcatgtagaccggtggtggaatccggcggttgaagaccaggctactgaccggacgtaccggatcggacaaaagagaaatgtccaagttcacctgatgataaccgccggaaccctggaggaacggatagatctgataaaccaggagaaacggacgcttgcaaaggaagtccttgcacagagtgatgagtatctgacaaatctctcaacaaaagaacttctggagattgtatcacttcgtgacagtctctttcgcggggaggatgcatgaggagacgcaagaaccgatggtggatcaaatccattcatgatgttcctgaagaaagaaagatccggctgaaagctcaggatggcccggttgggacgtcatggtatgcacgggattttgtcagggcaatggaggctgttgcagagaagaaacggcttgcccggggccttgactgtgccaggaatcatgaggcttccagactggtattcaggccgggatggattacgatcgggatcagttgctccgggtatacgattcgtgatgttgacttttcggttaccgagttcgtaaagcctgaatgggataaactgataaatacaattgctgcagatgcatctctgaccggggcactggtatccggggatttctccgaacattttgttgatgaactccggcgtgttggtattgacctgatcccctcgagtggccagggattttactgctattgcaactgcggtgaccatcatgatccctgtattcatcagatcgccgcacgatattttattgcagaggcactggatgatgatccctggaatcttctgtacatcaggggaaagagcagagatgatgtgttgaatgcggtacggcaggtcaagtcggttcaaacagagacggtgagcaatagtggcgggacaccggtatccggattttttccttcagggatctcactcccagaaaaggccgctcctaccgggtttttcacctgtgaaggggagggtccacttgtcccaatccagagagagtcggtacgggtcattcctataaagttgcttggaagatctccctattattttgggagagaaaacatggcagatgcagttacagaactgtattcctctatcttttcatatgcagactcaattcttcccgatgaaaaggaggaagaggagtgatcgctctcttccctatcccttcccgagtacagggttccagatgaacagactatttgtatgatgtgatacccaataagaagaggccacccatcccccgtgtaggagaggatattcggaaaaagatgggcttgtgctctatggatgaactggttgcctctggtgaaacctcattaggaggtccctctcacttattcaatggttgttttagtagtacgaccagaccattacccggtccaataattgcatatagccaacaaagaggagacacaactattattactaataaacgaaaaatagatttttgtttattggtaatatatgatccctcatcacactctgaaagaagtcattgcagatcaactgaaacgatttacgaatcaggaccctggtataccacggagaatcgatcctgaacaataccgtaacaaggataggattgtcgtcatttccggagtcagaaggtctggaaaatccactttcctgaaacaattatcccttggatttccctcattcttatatctgaatgctgatgatgaccggttgatcggtgctgctccagaggatcttgcatcccttcttttcatctgggaggaattatatcctggagtaagaacggtcttttttgatgagatccagaacatccccggatgggaacgggttataagaaggatgcatgatgatggataccggattttcctgaccggatcaaatgcacagatgctcagtagtgaacttggaacccatcttaccgggagatatgtacggattgaactttttccctttggatttgatgagtactgcacatttcatcaattctcgtggaatccatcaggcattcataccaccagtgaatctgctgctgctctccggcttttctcacagtacattgatgacgggggatttccagaatatctgaaagatccggatccggagatcctgcaaagaacatttgatgatattttattccgtgatgttattgccagatatgggattcgtgaagtcaaatcattccgattattatgccgatatttatattcaaatatgacgagagaagcaagccttacctctctggcttctgtcgtgcagatgaaaagtcctgtttccttaaagaactggatcggatacctggaagacacctatcttatcggaactctctctccctttgaatattcaatgaaaaaacaactctcaaggaaccaaaaatattacggaatcgataccgctctccgaaacgctgtatctttcaggttttcagatgaccacggccttctccttgaaaatattgtatggctggaacttcgccggagaggatatgaattatactggctgaaaggagagaatgaatgtgattttatcgtaattgaacagggaaaagtgagtatggcgatgaaggtatgctggaacctgtccgatgaaaaccgggaacgggaattcagtggccttatggaagcatgcaccccatttcatggatcaacgggatatctgctcacactccaccaggaagaatcaccagcaggggggattcgggtcatgccagtctggaagtggatcctggaacgataaaaatgtaattcatttccgggtaaggaacgagaatcattgaaagcatatccaaggcaataattgatgcaaatgataaagaatacaatgaaaattagcaatatcccggctaccctatggggcgaaaagagcaacaaactattcattgccgttcacggaaatctatctcataaggaagataccgtcatcgaacttctcgcagatgaggctactaggaaggggtatcaggtcctgagttttgatctcccggaacatggagaccggaaaacggaaggaactccgtgtaaggtgcagcattgtgtccaagatctcatagaaatcgggagatatgctcaggagaactggaatgaggtatcgctctttgcctgcagcatgggagcatatttcagcctgttagcttatcgtgatattgaactgaaaacagccctttttctctctccggttgttgatatggaacgaatcatcagaaatatgatgatgtggtttcaggtaactccagagcagttggaaaaagaagggacgatagacaccccggtcggtcagaagctgtattgggattattactgctttgtgttagagcacccggttgacagatggaatgttgatacccgtatcttatttggagcaaaagataatctggtcgaatttgatacgatacataagtttaccgaaatatttccgtgtaccttggaaattatggatgatggagagcattatttccatacggatgagcagttagacgtattcaaacagtggctggaaaagaatattgagtagaatattgcatggtatagataaaaatggagatattagagttggggggatctccattcccaaaaccaatatcgtgaaatctctcaataattctttcaccataccggataatgaaatggttttcatggtgcctgattttttaatgacgttgcttgtaagttcaaaacctcttttcacatccattcattcgctgaaatatctaacgtttgagggtatatcagccacataattgccgggttaaaacaacacaattaaatgataacatagagaatagtgacgtatgggttattgtagacaacttggaattttctgttcattggttctggttttttgtaccggattctgttctgctgctgaatcatcctccgcggttatctatatacaagggagcgatagtgcaatcacgaacggatcagatggaatgataataacagtaaaggatgtcattccctatttccatattaccgatggcaaggaaagtaaattggttccgttagagtcccttaccgatattacctatcccgtacaagcagtagttaatctttttaatgctgaaaataaaaccaattcagtaattcaggtcttaaatctggctttatcagaagataataaggtactcacgctgaatgttaacccgcttgagttttatgatggcgagatgctgaaatccctagccaatgggctgacaccactatcagacgagaagatcggtgaatacaatcgtgccggtatttatttagaggcagtctgggaggcaccttcaaatgctctgaattgcgtcccctgtttctgttgtgattttggaggaagtggagagtgtggggatatttgcacatgttgcacgcctgcatgatgttcccggtaattcggtagggaaccatctcacccctttacttggagatggtgtaattggtttctgttcttctagcgaataaaatgccctgtgttttactgttatttctccacggtgatatctattcatattgaatgataaacaaagggactttttttaaattgattcttaaggttaaattatcgctttttcaaactcatccaggctattatctaaccgggtaaggagttcagatttctcatcttcaggcagaaaactatatttgatactgttcctgtttatctcttttatctcgtcatatgacacatccggatgattcagagtgaatataacatattcctgggttaaattcgtacattcaacacccggatcatcagttgcaaggataaccgggacatcattggcaagataaactgcaacagggtgttcaggcccactgatattaagaatctgttcattactggtcagcaggatctcaacaggaatatccttctctctcataatagcaagggtattttcaaagccctcttcctcctggatcgcaaccccatgaccgattcgggaggcattcccgatggttatagcatcagcgatatgaaacaggagatcctttttttctgcaatctctccggttaattctccggcatgaagctcgataaacacatccgggtataccgaatggagataggcaatcatatccatgtgaagatgataatcatctgcagaatacggggcagcctcatccccgaccaaagtgataccggaaattacgggtgatttgttcgcaatctcaaatgcctggaggaggtcagtgaaaacctcctttttcggatagaatctgagagcctcatagatataccgggtggtaacgttttttccatccggatgagaaagttccccggaaatctgatcatatgatgagtgtttggcaacttttcgttcaactatttctgcaagaccggcatgcaggagatcatctctgagctgagacaggttatcatcccaatcgaccgtggataataccttccggacatcgtccccatttgtctgcgatgtcatcagttccagatagagtatattctcatcagcagcccggtcgcgaatggtagcaattacatccccgtcataatacgtaacaggatcaatgagatcaaatgtgttgaaaaaccagtcatgtccagactggttagtaaacggaaagtctttcatcgtccagaacctgacaagatcagaatacaatgtggaattattatatgcatcagaaaccggaaccagatgctgagtgttcgtgtaattatacggttgtccggtcaccagatccacgagttgaccatcatccggatttacgaataatccatgccggactgatatattgatgatatcatccggatgcatcgctcctgatgcatgaatatggatatcacccccttttggcatcttcttaaaaaatatcatgaggtcatccggatttttccggatagtctcaaaatatgtcgagattacagtactctgataacccgcatcagaaatgtgtaccgggcatgaatcctgactccctgtcagaaaaattccgcaaaaaccgaggataagaataataagaacagtatttcctttcagcacactcatcaaataaatccacaaattttgggattctgaaggtatgaattattcgaagtagttgtaatactgttcctgtaaaaaaccgaaaattttggtacgattagatggaagaaattgaggctggaaatttatcctgaattgatgatccgtaggttttttcgtcagaagagagatttccttcaagataaccggagtcatattcaagaaggtccataggaacatatacacccgaaattccggactcatcctgatagatatacagggtgtaattgggagaggaccaggttccgttccatacatatactgatgctgtttcgacatcggtcatgtcctctgcagccccaaaactcatacacaacatagaaaaggccaaaaatataccgaaaatacccatagttttcatacacaatcacttgtttccaggcgatgggttatcatatggggggataaaggtgtcgaattttacaaaagatagatgcggataggtaagcaacaaaagtaggttacttagcttcacgaatcaggatacaggtttcggccatccaatgttgataatttcgatctgacccatgaaaagacctctactgccattaaaagtgcattttcataatcttcttcagaaaccggatcataatcacccggatatcttgtattaacggcatattctgtaagagctgatcctgcaagaacgggttgtggaataaataccccggcattatggagcaatctgaataaattcccgatattatgggtccggggagattcaatatccaaggcgatgagaagacctttgagagatttttccgcagtctgctgacaatcgtaacagagatcctcaaataaaattttttccgtaactctgcctagtcgagcccggtaaagattactctctgcccgggtcatccagtccttaacaatttcccggtttttcatagagaaccttccccgattgggcaatctcccgataaataagatgagggttattttttttcttctgaaaagaatcaggcgtttctatcagaatatcaacaggtgcgtccgtatcccataagagttgatataattgcattgatagttttcttctttcctgaacatccgattttaaaatacaaatatcataatcactataatcattggcggtttctgttgctctggatccaaagagaataatcgaatcaggatcaacagcttccacgattatcctgataatatgtgagagaacagaatcgttcattattgtatcctatgaatgataattatgtatatgattgtattgttgaaaaagggtatggcttttctggtctcttttttatacagtcaaatttccataatttccgtcaccgtccctcttatcaatagagagtttttcatacacttttttcaataatcacaacgaataatgaaaaatttttcctcggatgaatgattatcaatctgttcatcagtcacttaaaatacctatcaaaactcatgtatgattccaattacaggaagcagttccatgaaaaataatctttaatttgctctgattatctcggttgctctgtgtgtattagccgtattcgtatcggccagtctttcgcatacggatgaacaatcggaaggactggaacactcatccccatagtctcattcaatgacacaccggttcagtatggagaagtgaatggagtaaccctcgggtaccgggaatttggatcaggagaacctctcctgatgattgaaggttttggggcaaccatggatgactgaggtgagacggtcattggcattcttgcctccaaataccatgtgtacatgtatgatcaccggggaatgggatacagcagtgatagtgataaagccccctcaatgtcacaatatgcggaagatgctgcagccctgatgtctgcactcgtacatgagcgtatgcatgtatatggggcttttatgggctcctcgatatcccaacaactggccatagaccatcctgaccaggtacagaaactgatccttgattccaacacctatagtctccttattcctgaaacaaaagtcctgcatagtataattgagacggtgggaggcaatacttcagagccgcagggacttcggaatgaagcacaggccaaccttgaatggaatggatcatatgacggactttcaggaatgaatacggatgttatgcttgttgtcgggactgaagatgtcctgactccggatgagctttctcttcagattaccggacaaataaatggttcctggcttgtgcggtttaaaggtcttccccataccggataccatcaggcaccggttcaatacggccagaatgccctgaatttccttgctatgaatcaatcgcccgtatgataacgggaaaaaattattttttgtggagttttattgtcgggatgaacttcatctccccctgacccacctggacagttccggtccagtcctgatacccatccagacgaacgagcagggtatggagtcctgtcctgacaatcagggaatcagccggtgtctgcccctgtttcactccatccacgtaaatatctgcaccagacggttctgaatagacccgaaccatccccgatggtccaagggaaggttcgctattcacattgatgaatgctgtttttctgaccgccccgcctcctgcaggcccttttacttcaagtgagacggtgtatctgccgatcccctggtagatgtggaccggattctgttcgctcgaatcggtcccgtctccgaatgtccagtgccaggaagacggagagccatccgagatatcggagaatgtaacctccagcggcggagttccagaaaccggtgtcgccgtgaaattggcagatatagaagatgggccggttgccgtgatatacccatcataatccgcaactccccagaaatcaacgacatcggtcttggtatcgtagatgttgtagataaccacgtggagcaggagtttcacgtcatacgtgcaggtttgtgcatatgtgtacaccgggttcatttacttaaaaaaccgaaaataatttgattttttttcagactcccccatgggatatagaactctcatctggagaaaaaagccgtcctggaaaatttttcctgcgctaacgatacagtaagtttattgatgaatatctcttctgatccggtttatggtatgaatccccctcatctgatcaggaaggaatatcaaaccactttttttttgacaagattcatgagagcacctccttgtgccaaggccatggttgcgccacaaattgctccaatcacaaggtcagtttttaataattcctttacccattcaattgatcggatgtgagaaggatctgcccatgtttgagaaaccggaaggaggaggagatttcaagcagccggattaatctcatttatagagatttctggttctagaaccatacctcccatagttgttaccgggttttgatagcatccacaaagaacaagatggtatgatattccctgtttgcaatattgccctgatcctaattctgcaaaaatatatcccggttcccagtcagccattttgtccgggacatagaggtacatgattcgtttcataatctgcgttcatcccttttctctgaatacataaaaacatatgacattcaaaaaagtggattatgtcatataatttccctcttacatgttctattgcgattttttcatgatgaaatacgtatatccatactcttttgaatatttccggaagatgttcatctccatctccagtccctggatgatgaactgtgcatcctgattcccggcatacttttctttgagcattccaagccgggcagcaagaggattgtaataatgggtataccagccggtatcaggaagccggaatgacccaactaatgaatacccctctgcccgtatcatctcctctgcttgtgccacggttggcatatctggagagatctcatgcatgaactgtgcacattcttctgaaggagaatcggtaaaccaggtacagtcagagatcatcatgtacccgcccggttttaggaatttcttccacgtctgcagggccgggagaataccaatgataaacgctgaaccttctgcccagatgatatcaaatgacttttcatcaaatggcagattatccattgaagcccgacgggtcgtaattctcccgtcaagtccggctttctgtgcccggcgggtgagatcatccagaaacggctgatggagatctgtagcagtaatctgacaatccggacagatccgggcaagagtcagatcctgcataccggatccacacccgatatccagtatcttcccccgtttggcatcaggaggaagaaaagagaaggcaaatgctgttgcttcgtcaagacccggaccctgccggggcaatccttcaaacattgaacagataagtgttacatccatgggggaacacgttggaatgaagatttcaaatgctttctgatccattccggatgaaatatccaaaaactataattccgacgtatgaaccaggcgtagaaaaaccggatatcccagattcgagaaaaacatattgattcatttcgtataaaatggtggctatcagatcacacccggtcatcagccatctcataacagcaataccggtgatcctgccatagccattcacaggccagcacagccggaacaaacatgggtttataccggattctgatgcggaaacgctttttcgtccgatcccgtactgctcttttcccatgagcctgctgatgacaggaatgacagagaacacgaagatttgacgcggttgaatctcccccttccgagagcgggattatatgatgcactgaaagatcacgctgttctccgcatatctggcatcggtacccatcccgctccagtatctgcctgcggataacattccaatactgtggccgtcttcccctgatggatgcatgttcctgctcaacccatgaataaaaaagatccctgcactgggaagagcagcatgaatcaaaggagtgttcagaatcaagaggcatttcacaccagcgacagagcccggtgtggttcaggacagactcaccggattgattcatccaaacagtaaatcagcatgaaaacatatagtgttttctatgaagcaatgaagcaatgtgaagatatagagagatatgatgatatcataggaactatagtctcatgaccaaacccctatctgcatggaggtacatggaaagcataccatgaatcaaaccacccgttcatgcacgaaaattacagtatctgataccgatgcatcttccctgtacccatcttcatatcaggatcatattcctgaaccggacgtcagacactcagcagggaggagaatcgaagaccatatcagctcatatccgaaggcctcccttgcctgggagttattaataaaagtcagccacatatccgtcctctgggacatggcagcctttacgaccaccgaacgactcaggatgaatgaccatggaaggatccatgcacaggtaactgctgcatctgctcttaccatcctggatctgctctgttcatctgatattaaaccggatataataaaaaaagggggagatttggatgatgcgatgctcatagtcctggtaagtgccctgtgccatgatatcgggaatgcaattcatcgggattcccacctctcacactccatgatgctggcccagccaatccttgatatgatcctgccggtcatctatcctgacccgaaaaccgctctgcttatgagtacagtgatcctctccgctattcattctcatcacggagatccgaaacctctgaccatcgaagggagtattatcagtgttgctgatgccagtgacatgacaaaggggcgtgcctgtcattcgaccgatatctccactgcttccatgcatgcaatatccaccctggcaatcgatgatgtgataatcaccagaggactaaatcgtccggttgagatccagatattaatgtcccagctggccgggatgtttcagattcatgaaaccctgataccaaagatacatgcagggttgttaaaagaacacatcaatgtctatattccgcttcaggaccagtacatctattaaaaactcgaatgtgtgaatgaattatctccaatatgatcaggaaacctgtgaaatagtatgttcagaggaccggcgagttaacattcatcagaaaacttgtacggaactgatttgggttcaaaaaaaataaattgaatcatgacaaacgtgtttaaaaatgaacccaattgtatttttgatttcattcctgccgtggatccttttcggattatttgccggccattcactgcttgaacttgaaactgctcttattatctctttagttatttcggttatcgtcggataccgggacatgcgggacaaacttatagtgccctgggtaacattctccttttttgtgggaatggtcatcgccctgatagtccttcagtggtatagtatcatcccgtatattggaattgcatccaatattgtgctcacgggaattgcatttggaagccttgcaattggtattccctttaccatccagtatgcaaaacgggatgtcccccgcgaacgttgggaaaacccggttttcatccatattaataaaattctcaccgcattctggggtattctcttcttcctgggattactgctgagtgtatacaagttcttttatccagatacgctcgggatattcggtgatgcatacatgtggatttccatcatcgtcgggatttttttcaccatgaaatacccggcatatgcgaaaaaaagaagtcagacataattaaaattcagaaaaaaatccggtcatggattaaccatttcaagtcttttttccgataccatcgcagaggaacccgctgcctgcatgacctgctccaggcctgtgaagtaatctctttctaataacaagcaaaagagagaaagggcgtctatgtcgggccctggctggctggttaatcatcctcaatgatgtcaggaaacagaatatcagcaatgatatgggcagggaataggaagagccagaaatagagggcgaaagacggcctgataaaagagagcggaattgagaggagaaagatactgggactgatataattctttattcttgtcagtctgacaaaatcctctggcagatccttattgatatgcagatatctccgtgatgcataatgccagatgaaacctagtaaaattcctggagcagcatatccgaatgcagcaatgattaccgccagctggatatgtccatactcattgatgagtttcgtgacaaacggcatcatgatgatgaacagcaggaaaaacgtattcagccgcatcagaataccgtcatagccgacaataaatctgaaaatccggtgatgatttgaccagtatgctgcggtgatgataaaggtcaaaaaaaagtagaggaaccgggagtattcatcaacaagtccctggagcagaagtgcatcctgttgtttctgcaggtcaggaaccaccagatcaattgccagaagtgtgagggagaatgcaaagaccgcatcactaattccgataatacggtccagccctcgtctttcgtaataatcacttcttttcatgcatccttcctgtttatgagagcagcataccgacaatcacaccggcaagggcggcagcaagggcaattcccatcgtttccgcaaccgtccggacaggacttctgttgcttatccgtgcccggcctattccaaggagcagaagcagcactgcagtaaccacgatacagatgatccaggcggtgtgcatcgggaataagacaaagggaatgaccggagtcagaccggcaaagagatctgacagaaacatccagattgaatggataaccggagatgtcttctgccctatggtcttctgactggcagcgattgcgatctctaatccggatatggtggcagggttttttgaaatatctgcatgaatgaagttgatggtctgttgtgagaggcctgaattctgaagcagccccatcaggtccgataccgccccttccgggttcttgttgatggctgcaatccgctcctggttctcttcctcttcttcatcacgctcggattcaatctccatgaagcagccggccatcatcgagaccgatgctgcaatggctccggtggcaccggcaagaacgaccgcatctgcagagtccgctcctgcagcaacaccaaggaccagacccagaatggagaccgtcccatctgacatcccaaagaccacttcgccatatgaggcggccagcgattgtttaatacgggatataaacaacctttccgacatgataatatatccgtttcagggttgtgggttatcgggtaaaatacctcttttgtcgtatagcatgaatggaaaattgaaaggatcagacctcatgaacccttattagccctcttactgatgtgccgttccttcggaaggcgtcacgagcaacatgaggaataacccggcaaatgatatgagcataccaaacaggaatgcaaaatcaaaggcaaaaaccagatctgatggtggaatgagatgagaagagacctctgcaatctttggtcctgctgcaagaattgcaatgaatatgactgcagcaacaccaagtgttgaccccagattactcattacccgcaggagacctgatgttgccgcccggtcagataccgatgactcattcatcagtgcagtggtgagcggggagaatgctattccagtcccggcaccaagcagcataagatataacccaatgtacccaatcctggtatctgcagtgattgtggagaggaaaaactgggcgattgcacagagtgaaaacccaaccagaataggtttttttgtcccgatgacatctgccattttcccagatatcggtgcggtcaggatcatgccgaccggcagggcaaggacaataagaccggttgtatctggtggaatagccctgacaatctcaagatagaacggcataatcaccagcactccggatatccccatctggacaagaagtattccgacactctgcacagaataattgcgatttttaaaaagaaagagatttatcaatggttcttttgttctttgctcctgcactatgaagagtgcccagcatgccagtgagaaaatgatgaaagcactccccatcaccggattattcttttcgattgtggtcagtccgattatgagcaatgaaagtgcaataaagaacaaaagaatcccgggaacgtcgagctttgcatcaggaaaaagaggctctttgtgtggaaggatatagtatccaaggattatcccaattattccaatcggaatattcactccaaagatagaccgccatgagaacgcactaatattcaagaggggtcagattctgtcccgcaggcatagtattcaccaaacaacatgtacgaaacaatggaaatagtttaccacacgatcaggtgatcagatcatccatctgttttataacagatttcatacagaaaaagagaccataggatatattcaatccgaaattttcatttgtgattgttgatggaatgattatgtacatctgacgcacacgaatttttccctacgaaaataaaatcgggaatgatttatactatttatctaattttaaatttttcagatgttttaagagagtacaccattccattacttccgctatactcactgaatatatatagtccacgagaaaaatacacaaccatggtagaccggaggctaattccatttattctccttattctgatgggttttatcccgtcaggacttggatgtaccacctttgttgtcactgatgaagcatcagaggatggttccacgtttgtcggacattcaaatgacgggttcggggtgggtctcataggccacgagatccgggaggatatggtttcgtttcgtcatatcatcgcaaaagatcatccagctggggcaatgagaccggttgtgtatgatcccaacagtggaggggagttccttggcgaggcgccttcatcagacactcaaacgattatcatcggtgagattccccaggtaaaccatacgtatgcctacatcaccggcagttatggtattatcaacgaacaccagctcatgactggagaatgcacggactatgcaaaaattcatccgggggcagagaaggggaaacgcatcttttacagttctgaactctccaatatcgcacttgaacgatgtaaaaccgcaaaagaggctgtcattcttatcggagaactgatcgacacctatggatattacgggaccggtgagaccctcatctttgccgacccatcagatgcctgggttatcgagatgtgtggcggtacccctgacgggaccggggggtactgggctgcccagagaatccctcctggggagatctttgttgccgcaaatgagttcaggattcgggaactttctgaggataatcctgaccagatatttgcgaaaaacctcaaggatgatgcacagacgatgggctggtggaaaccggaagatggcccacttgactgggctcaggtgtttggtatcggtgaatattcgcatccctattactctcagggcagagtatggagaatttttgaccggctggctccatcgttaggtctttccccctatgttgaagggccgttctcaaaagcatatcccttctcaataaaacctgattccccggtaaatatcacgaatgcactctctatcttccgggatcactatgaagggacggtatacgatctgactgctccccctgctggcggtccgttcggagatccctaccgggtatggggtccgtatgatctccacgatgctccctacgaaggacagttaaaaccaggatcctggccacgacccatatctactgatccctgtggatactcctacatctgtcagggcagggcaaatctccctgatcccatcggtggtatctgctggcttggcatgtcttcacccgcagagacatgttatcttcccttctatactggcatatatcacttaccagctccgtacctccatggctctcactgggagtttgatttaaataccgcattctggccgtatgaactgcttcagaattatgccaggctcatgtatagcaacatggcacctgaaattaaggctgaacaggaacgaatagagggagctgcaatcgcaaaccagtcggcaattgaggcgaaggcgcttgaactctacaagacagacgaacggtctgcacgtgaattcctgactgaatattccagtgagacagcattgaacgccctcaatgactggaaaaaacttatgggagagatgatcgtcacctaccggaacgggaattacaatgatgttgataataaaaccatcagtaatatcgggtatccggactggtggtatgaatatgcccggtatcagtatggtccacgggtgtatgatattcagggattaaacgcaattcctgacgtaaaatatgtcggagaagaagcgaatatcacaggagatccaatctcatacatcgagaaatatcagaccggataaatagagagatcattatgcagaataatgaaaaacctattattttaaaaggaatcacaaaagttgaaggatatgctgaaggagaagctctggttacctcgagttttttaagccatctggttaatgcagtcaattctgacggagttatcagaatatttggccatcctctcgtggggcagtcatatgccgggaagattgtggtatacgacactgacaaattttctaccggaggtgcatggggcctctatttcaaggcaaaagtaactaattcagctccaaaggctctcatctgtcggacggtccatccgatcagtattggtggtgccattgatgccgggattcctgcagtggattcctttgatgttgacccatggaccgttattcagaccggtgattatgtgaagataactgcaccaaaagcaggagatgaagggattattaagatttatccgaaagatcctgcacggcgggcagaactggcagaattaaaatccttaccaaaaaaagggtgggaaaaaagtgacatctcacttaccccctatgaacaggagatgctggccggaaagcatggtagaccaaaacaagtagccatggaacggttggtgaaatttgctgaagggatgggatcaaagcgtatggtgccgatatgttccgcccatctctttgatgaccatcagagtcgtgattataccgtcggggcatggcctgcatttgaagagttcgcgagtatgggggctaaggtagtagtgccgaccactgttgagagtacagccatgggagatgatcttgtcgatgataaagggatgccctggcactattccgttatggccccggccagggaagtgttcaaggggatggttccggtccatgaaaacctgaagaacatgggtgctacggtgatcccgacctgtatcccctatgcccacctggccccgccaaaattcggtgaatatctcgttacttcagagtcgaacgctgctgcatacagtaatattatgattggagcgagggtaaacagggaccctgcgaacatggttctctatgctgcaataaccggtgtcatgcctgaatatggggtccacctgcaggagaaccggatcggtcagatgatctttgacgtagaccctgccgtggtaaaggaacttgatgatgtcggggactatgtggcacttggcggagcgatcggattccgggctggtgacagggtacctgttgtatgcggccttaaccgaatgacaaatgctcaggcaaaggcattttgtgcctgtgtatctcccgcattgacctaccccatgatccatatcgtcggcatcactcctgaagcaaggacgattgaagaggctttcggaggggagatcccaaaggatgttgagcgtgtacgtatcaccaaatcagatcttgcggcggtatatcagaaccttcgacagacggagaagaccagtattgatgcagcggttatcggttgtccgtttctgatgtttgaagaactagcggatattgctggaatgctggacgggcagaaggtatccgcacctctctggctttacaccgactatgtgaattacagtgcagcgaaaaaggcaggtatcctcgagaagatagaggccagcggagcacgggtcgtgcattcatcctgtccggggatggtcgtcagggcacctgcagatgcggagaaacttgtctttgccacagacagtctgaaagttgctatgctctttgccggtataggctggccgaagaactggcttggaacacgaaaagatgtcatccaggcagcgataactggcacgtatgttcagaataagtggctgaactgagtacttcctttcccagggccaggatacattagggatgtctataaacgattagcaaagaaactggacgaattgccacaggggttcccctctaccgatacaggtgttgagctcaggatcttacagcacatcttcacccctgaagatgcagagatggcacttcagatgacgccggctcctgaaaccgcagaacaggtagccgcaagactttcaaaaccggttgaagagatccgtgcaatgctggatcagatggcagaaaagggacagatagcctcactaacgatagggggacaccaggtctaccggttcattccttttgtcattgggatctatgaatttcagcgtaaagaaagattaacgaaagaacttgccgaacttttcgaagaatacgggccacatcttgcgggggctacaggaggtcatgcccctcatatcgctcgtgtcataccggtcaatgctgcaattccaaccgatcttcaggtgctccagcaggacgatatccgtcagatcctcaataatgccaaatcattcaggcttcaggactgtatctgtcggaaggagaagaaacttctgggagatcactgtaaacataccatccataactgcattcattattccatggaggagaatgcctttgattacttcaatccggagggtgagatcatcaccagggaagaggcatttcaaatattagaacagaacgatcaggaagggctggttcacacaacctataacataatgaatgttcagggggctttctttgtagttgttgttcctgcagttgtgcgatgatacgggctctgaaggagttcaaggccccatatatgatagcgaaaagcaattatatggcccaaatcgatgaggatgcctgtattgcatgtgggatctgcagggatgaacgctgcccgatggatgcgatagttgaagaagacggagaatttcaggttttaaatgaccgctgtatcgggtgtggtgtgtgcataatcacctgtccttccaaagcaattaccctgattgaaagacctgtgcaggagcgggatccgattgcgtctgatatcacagaatggggaaaaatgcgaatgacaaatcgtatgctggatgaacagaagatccagggtgttccgaaatgaagagatgaagagatcaataccgaaaaatattttatcatagaatacaatcacaagcctgcgaattattctggtaatttgcggtatttcgccggaaatttaggaatactaccaccagtactacattttttattgtattttccatgcgtgatgaaacatcctttttcctctgggttgatatattaaggaatgagccctatcttagcgaagaggtatttagtagaggactttacagacacgttcgatcttatcggagatcgactatcaaaatccctgattcaggagattctatcagagtatgaagagataggggctgatgatccagataattttccagtatcttttgactgcgagagtttgcttactcttcttggagaacatgaaaaagccattagatgccttgatcagatacagtgtgattatggaaaagggatgcggatgctcagatatgcctcccattatgcaggtttaaatgacattgaaggtgtgaaaaaatcccttcatccgctccttaccaatcccacagatgaacatgaaaaagaatgtgcatttatcgccgcaggccgtattggggatcgggatttggcagtccggttatgggaagaacttatcagggagaaaggacttggaaaccagagaattactaatgaagtaataggaagtccggatgctttcaactgtctttcccacctgcaattccgtgaatggtacgagggaattcacctcctctatcggtatgatatcaaagaaaaccgggatattgaactatgtgccctggtatctctgcttcattatcagatcggaataatttataataccatcatcgatatgattcagaataccggcccgtatgagtcattcaccgggcttgtcgtcgccattgctgtttcaagtggaacccattcctggatcactgaatttcgggatattgcaactattgatgaaccaaaagtgtatcacgaacttatcctgaatcttgagggagtgcgcaaatacctggcgttctttaccataggtgagcggttacttacgatgtccacatcaggttccaagcctgataaatcgtccatatacaaacttctccgtgataccggcggggatatgtaccaggtttttactcttctggagttatttaccagggtagcggatgatgctgattatgtacatcttctggatattgtgctgcaaatggaaccagatatcgcacgaaaaaccgtgatacgaaaagagatggagggatttctcggaccacagcctccatttgactatgtatagggatactcagaagaaaacccgaactttttttgagcagccgagtttggttactgcgaatacgaacatgtcagtcaggaatataagaggatatcttccaagaggatattattatggaagaacatagtacaactatggattttagccagttgattcgtctcaatatgagaattattgggacagtacaacgggtaggatatcgtcatattgtccagaatattgcgcgaaaacataatatcaccggcactattgaaaatcttgagggctatgatgtcaggatcgtcgctgaaggtaccagaaaggatcttgaagcgttcaagcaggcaataaaaatatctgagtaccccatactggtagaatgtattgagtccagcgaagagccatatctcggatgtttttcatactttcaggtcattcggggatctccagaagaggaactggcagaacggtttgactcagcaatcgcgattttttcacgaatggagagaaaacaagaccaggcattggaaatgcataaggagtccattggcctgcagcaggaaacactaggacttcagaaggaaacaatttcattacagaaggagacattaggacttcaaaaggaaacattagaacttcagaaggaaacattagaacttcagaaggaaacaatttcattacagaaggagacattaggacttcagaaggaaacaatttcattacaaacagagactgtttctctccagaaagaaacccttgaggagatcaaaggtaccagatcagaccttgacaaaggtttcaattccgaacttcgtgagatgcgtgaagaactcagagaaattcggaatgccctcatacatgcaggaattatgcaaaccgtgaagtcctaacagggattaactctgataagcagggtttaacgttttaaatttttgcaagatagtctccattgaataaacacggcaaaactcaatcctttcccctttcgttcacttataccatctctccgataatcaaagcactattcttaatgcacaatcctgaatacctgtacgtatggcctaccatggtgatcttgatgcatggtacaatacgggatatgcattgaaagaacagggtaaatatgtgacagcatgacctgtggaagaaaattattcagaataggatacgtgtatcacgttcttccagaagaaggggtggtgacgatgaggaaaaatgaattctggtagatattattcacctgattattcccgatgcatcaccttcacccggtctccaagttctctgattattttctctacccagatatcccatactaccggttcaatgggaaccttttctgcgatctcaatgcccagttcatcatcccgttccctgacaacttgtaaaataacactgccaggtgcatacccttccggcacaatcccgtcaatatcaccgtcggtaattccaagaaccggtatgccccgggaacacccgatatgaccacagattgaggttgtgtcatctccgatggtgacaaggccgcagatatcaggatcaaaggctccaaaacaggccatggcagagtgatcaatgacgacaacatgtccctcctgcaccttctgggaacctttcttaggccgcgatatcctgatatttccacttttacaccaggctttcgagacatccggacatccaaaccggatgagtttttcaactccgtgatctttcagttcaattccggatactgcctgaatggtcccatcctgaagtgatataaccgcttcttcaccggttgcaaagccgatgatgatcccatttacaaagaccggttcaccagggagacaaccgccgatgacccgtgtatcaggaggagagctctcatgataattacctgaaacgaccggatatccggttatctctgacaaccatgttgagagggagggatctaccaccccccaggttactatctgacaggttccgggatcgataagaatgagcccccggtctttgaggtgggagtggataagagacccgaaccggtgagcagaagcattcgtttttgcccggtggatgagaactgcctgatcactttggtattcggaaaggatttcactaggtcgtctaccatcatagataaccgggagtcctgattcttcagctgctgtccgggccatgactccggcaacaagagataaacgagggtgaaggagggagataagccgggctgcatcgccgtagtcaaaaacatcggctccgtgaaagatgagggtgagaatgtgagttggaatagaaaggcctccttgaaaaccaggtatgttattattgataataatcctgaaggttcatccttggggtttctttcatgctatcaaagtcagaatcatcagaaactatcactttcaccacatagataagaattaatgaacaagtctggacgttatccattattattggtcgttaaacatgattgaaaagatgtatttgaggattttaataccactcatacgggaagacatgagaatcaagacaaaaataattcattcgctcctcatgctccttttcaattacatctttgaaagggataggttttttcaacttatttttgacaatcgaacaaaaattttcaagatttgaatcggtgtaacgttgtctcatacaacctatctcttttccctgaaggaagggaacgatgaaagacggagcagtaatgatgaattatccttgcaatatgataaatatatcaatgagtaggagcacgtggggagtctgccttcataataatgaaggtgatgcttgtgttttccggtttttcaggatacaaaaaaaattagagagaattaccagcgtcaattttcagggattaattcagagaacaccaaaaatttcaattgaatgccaggttctactgtataaattaagggtgcacattttgccatatatgcacactttatcaattagggtaacgaatttatgaatatggaatcaggtattcataaagtaaaccaaaatgagattaaacgaattcccattaaagttccaacctggcagggtcttcatgatctaaaagaggcagggcagagttatgataaccttattgccggaatgataaagcgtgaaaaagattatcgtgactggcagatggttatgaagattgatcagtcgggggaatttgaaccatttgatgcagagaaaattttgaacggagactctgcggaagagggataagaacagtgtttataatccttattgaaaaaaaggctcgtgaatatcttcagaaattgccaataaaaacccgtcgcattattgttgagaaaattcaggaactgcagataaaccccttttcaggtggcaataaggaaagaattgaatatcataagcctcccgcagtgtatcttctccatatatcccgctcttatactgtattttacctgatagacgaagaaaaagatgttgtgaaaattgaaacgatagaaacgattgaaaaagcccataaaacatacaccagaaaataatgattgtgaaccatgatttttgatgggatcactagtcgtatgcaaccggaactgatttttcctattgacttcaggctgaggagtaataacaactcattaaacacctgtacgtcgacatatactcacgaatgggccattcaataactccaccactccggatcatttcatggaactaccatccgctgtccactcaaatgtccacactgttattctgacgccgggacccgcgatgtgtcagacccgctctcaaccaccgaggcatttggcattcttgatcagataaaggcgaccgggaatcctgttgttatcctgagcggaggagagccgatgatgcaggatctccctgaagcaaaaagtctggtcgcttccatgaaaggaggatgtagtgcaggcatcagagttgtgaacgtgaccgagactggtgacctctatccatgccagtttgcacaaataccagagtttcgaatcggttcaatacgggaacagccattctcgaaactctggaatgatcctgaaaacccggttctgaaaatgttcaggggaaaaaaggagtgtctcaccggaaagcgccgatcctgttcatacctggacctctgcgggggaggatgccgggtcagggcatactggcagtccggagaattttatgctgacgatccgttctgttttatagaaaaatggaccacgcatagccctttctcacggaggatgaacccgaatgttccagcgatgaggaacggtcatgatagtatatcaggttgtaaaatgaatgtcatatacatgatcgatctgtaccccactgcttaacgtaccgatccacaatcctcgtttgatctcatcagaaaaacctggtttcccggtttttcaaaccatgtgctctttgatagtcttgacaatgatgagcaggaatatgcagagcaaatattactggattttaccggatttgtcctctactaccagaactgcgttccggaggactggtcaccgtctgtcatcgagcactgcctggtaaaggattttccccggagaaaaccggttgatatctcatcaatacaaaaagctacccgcgactggtttatggccacaagtaaaatgactgacgcgttctgcaatgaacggctggatgaagactatgccggactctgcaggcatgttgcaggaaaactagcacgaaaacgggataataaaattaccaggggaaaacgtgaaatatgggctgcaggaatcatttatgcagtaggacagatgaacttcctgtttgataaatcatttgagccatatcagtcagcagatgatatctgccagtactttgggaccagcaaaaggacgacttcacaaaaagcgaaactcattcgggatcttattgggatggatgattactgggaccccgaatactctacatcatacatgcggaataaaaatccattcgaaaaattttgtatgacaaagaacgggtttataatttaaataaatctacatgcaaaaagtcataaaaaaaagataattattactacaccgtcaccggaggcttacacttaaaatttataagtgatacaatgagaataggagaacagagaaatgtacataaaatttgagtcatattttgacggaaattactggtgtgccagaggcatcggggtggatatttttactcagggaaaaagccttgatgaactaatgagtaacattcaggaagctgttgaactgcattacgaagatgaactggaaagaggcgagtcaattaccattctgaccttgcaggaatacgaggtaagatcacatgcaagggctgccagttgttagtgggaaaaaatcataaaagctcttcaaaagattggttataatgtaataagacagaagggcagtcatattcagatgcaattagaatcagaacaaggtattcacacaattacaattcctctccatgatgaaattgccctgggcacactcaacgatattgttgggaaggtctctctatggactggaattaataaaagggcattaattgaacgaataaaagaagaataaatttttatttttttatctcatactccattccaggttccagaatcactgttttcatatcagttgtctcattgatagcccgtgcaaactcagatacatcctgcctgattttatcaaaggtattataatgaatcgggataacaaccggtgctccgataaactctgcggccatcatcccttcccgtggacccatcgtaaatctccccccgattggaataagagcaacatcaggatggtataactcaccaataagacgcatatctgaaaacagcccggtatcacctgcatggtagacggttctcccatccatgctgataacaaaacctgcagcactcccgccgtacatcccgatcccttcgtcttctaaccaggatgagtgaattgcctgggtcatggtaaacgagataccatccacgactatcgtcccgccgatattcattgcttcagtgatgcacccttttccccggaggtaatgagcgatctcattatttgtaataatcggggcagtatacgatgcagcgatacccatatggtcagcatgggcatgggtgacggcgacaagatccggcgtgactctgatctcgccctcaggaataaaggggtcgatcaaaacacactttgacccttgcagtacgacacaggcatgaccaaggtacgtaatcttcataaaaaaatcaggtgatatcgatcagctctgcttcggtgatatcaatggactcgccaaaggcatcctttgttgcagaggaggtcatactctcagtgaggtcacgatcttccataacatcacgaatacgttccaggtactgatccatctcccggtcaaccatggcttcaagaacatgccggtactcccggagtgtagacgggctgattcccagttcttcactgatctctttcatggtcttgccggatacgagcagatgttccatctggttccggtcaaatggcattttaaagtccagctcacggaagagtttcatcctgacacgggcacgggcaacagtcttggagagtttttcatctccaagttccctcgcaatctcagtatcatttttccccgcatagtaggcacaaaccagctttgccagctgaataggtttcagcttcgttttgaagaaaccctggtcaaggagttctcgcataatgagcgcgatctcccgttctaccgcatcgctatcacgaagcgtaccatggatcttcttcatcggttccacaatctttgtgttaccggtcatatttgcgaacagttgtaacagctgttctttctttgcaacctcttctggcatgaggaatcacacacattcgggataccgatatacataccgctaaaattatttaagtttgttggaatttttacgtaaaaagaccgcaatccattatatattcattgcagaggagggaaaaatgagcaccagagatccggtatatgacaggacagggtttatcaggatcctgaaagccgggctgagttagggcagatacagaagaaaatcttcatcgtagatgagagcaatatgtatcccggtttgtgatcccagatgagcgatgtctttgataatgtgatggatctggcaaaacgcagagggtttgtctggccaacgacggaatgctacggttcggttgcagggtttatcgattacggccctcttggtacgctggtcaaacgtcgtatcgaagacctctggcgccagttctatgtaatatctgaagggtattatgagatagaatgcccgacaatcggccaggaggccatgtatatagcatccgggcatgtcaagggtttttctgataagatgtgccagtgtccggcatgtaacgaatatctgcgggccgatcatgtcgctgaagctcacaatattccaaatgcggccaccctttcatgtgaggcactggcagaaaagatatgcacgctcccctgtccggcatgtaatgaggtccttggaaaggtcgaggtctttacctttaacctgatgtttcagacgaccatcgggccagggtcacagcgaaagggataccttcggcctgaaaccgctcagggtatcttcgttgactttgggaggctgctgcggttctaccgggataagcttccgttcggaaccgtgcagataggacggtcataccggaatgagatctcaccccgtcagggaatgatccggcttcgtgaattcacccaggctgaggctgagatctttgtccacccggagatgaaagaccacccgaactttgcacggtatgccgactatgcattcccgcttctctcatctgagcagcagcttggaggccttgaggcaaagacctacaccatgaaggatgccgtggcagcgggagtcattgcaaacgagtatgttgcctactaccttgccctgacccacgaactcctggtcaccattggtgtgatgccttcacggctcagattccgccaacatcttcctgatgaacgggcccattacgccgaagactgctgggatgctgagatattctccgaacggtttggatgggttgaaacggttggtattgcagaccggacggattatgatctgaaggcacatgcagagcagagtggtgactcttttaccgcatatatccagtatgacgaaccacgacgggagaagaggcgtgtcatcaatgccaacatgggtgtgctcgggccaaagtaccggggaaaagcaaaagccatctctgatgctctgcaggaggtgactcccggacccgatggtgcaaccgttatcatcgacggggaagagatctttgtcccggctgatctgtatgaggtgaaggaagaggaggttgatgtccggggtgttgatgtccggccccacgttatcgagcccagttatgggattgaccggatgatctatgccgtccttgagcactcgtacttcgaagaggaggtagaaggagaggtcaggaaggtcatgcggttcccaagccgggttgcaccggtgcaggtagccatattcccgctcatggcccgtgacggtcttgatgtcatggcaaaagagattgcccggacccttcagatgcaggggattcttgcagaatatgatgattcaggagccatcggtcgccgataccgcagacaggatgagatcgggacaccatttgccgtaacggtagactatgattcacttgaggatcagacggttacccttcgtgaccgggacagcatgcagcaggtccggattccaaaggatcagcttgttgatctgatcccagcccttatcaggggcaaaagctcattctcttcactcatctgatggaatatatctcccatccttttattgctccggagacgatggagaagagaacataccagttctccatctccatgaatgctcttgagaaaaacacccttgttgtcatcccgaccggcctgggaaagacagcaattgcgcttatcgttgcagcgtcccgcctgtaccagaacggggggaaggtgctgatgatggcaccgacaaagccccttgttgagcagcacctccgctatttcaaggcacatcttgccatccccggtgatgagaagacgaaatttgcaatgttcaccggtgaggcatctcctgagaagcggaccgcagagtggatggcggcatcgatggtccttgcgactccgcaggtcattaagaatgatctcatcgccggccggtacgatctcaccgatgtctcactcctgattgtggatgaaggtcaccgcgcagtcggaaattatgcctatgtcttcatagccgaacggtatatgcagaccgcaaaggatccgcttatccttgcgatgactgcgtctccgggcgggaacaaggagaagatctcagatatcgtggaaaatctgcacatcaagtcggttgagagcaggactgagactgatccggatgtcaggccttatgtgcatgagaaggatgtggaaataatccgtgtagacctcccgcctgaactaaaagcggctcttgaagatttgaaggcgctcgtagcagaccgacttgatcaactcaagaaagccgggtttccggtcaccgatcaggcttccctttcgatgaaaacacttcaggaggtatcggcaatcatccagcaaagaattgcagagcgagatgcttcaggttttgcagcggccagtattcatgccgaactgatgaaactcaggcatgccattggtctagcagagtcacagggctgtatggtcctgaaggcatacctcaataagctccttgccgaagggaatgcacctggcgggtcaaaggcatcaaagagaatcgcctatgatccccggttcatgagacttctcaaccgatccattgagtggaaagaagagtgccaccccaagctcctcatcctccctgagctggtacagtctatccttgatgagtccccagatacgaggatcattgtctttgcaacctaccgggatacagtcaagatggttgttgatacgctgcaggcagcagggatctccgcagagcggttcgtcgggaaggcgaataaggaccaggaaaaaggactctcgcagaagagacagattgcaaccatcagccggttccgtgagggggagttttccgtccttgttgccacctcagtcggagaagaggggcttgatatcccgtctaccgacgtggtcatcttctatgaaccggtcccgtcagagatccggagtatccagcgaaagggaagaaccggacgtcataacacgggacggatcatcgttctggttaccaggaagacgactgatgagaccttccagattgtttccagaagacgggagaaggcaatggtaacggggatgaaaaacctgaccggtcatgagaagaagatccttcagacagccctccctcttgacctggatgatctgcaaaaagcgaaagcagcacaggaagaggtattttctggtccaaagatcatcatcgatgaccgtgaactggtctcaaaggtgtcagagcatctttcatccgccggggcagtcattcgtatcgaacggcttttacagggtgattacaagattggtgaccgtatcctggttgagcgcaagacatcacgtgattttgttgacagtcttatcgaccgggaccttctggatcaactgagagagatggcacgggtctgcccaaaaccggttctgatcatcgaaggaggggacatctattcccaacgggacatccatccgaatgctatccggggagcgcttgctgcaatttccgtgaccatggggatcgtcatatttcagaccagagacgccggagataccgcagacctgctcctggtccttgcacgccgcgaagaagagaacggatacaaggagcgggggtccggccaaaaagaagcatatgagagtcttgcaaccgcccaggaggccatcatgagcgcatttccagatcttggacctaaatatgcccgtgccctgctcacggcgtttggatcactcaaagcgattattgatgcagaaaaagaagagctcctccaggtcccaggtatcggggcgaaaaaagcggagatgatttacgagttgtcccgtcgtccatacccgtaaaggagcagggcatatgcttcagccccttttttaacggactccataaggttcaggatccgggtactatcctgttcttcgcgtgcctgcataaggagggtccgaagagtcagggcaaactcatcttccagtccacctggtgcaaccggttcctgtcccgctccctcagggccggaccgggaaggtgtaaccggaggtcgttttgtggtctgattttgtagagcctgctcctggcatactacacagaacgtctctcctttatactcaaagagcggggaatggcagacaggacatgtctttgagagcatcttccctcccttcaggaggtactcagccattatctcatcaggactttttgtatcggtcatcggtcagtactgttttatggggtgggggtctacttataagcgaaggttcacgcaggtgagaatatgccaactccagaacaaaccatcgatatctgtattcagatgttatctgccattattgacgatggcaccatccccagaaatatccgccgtgtagcagacgagacccgcactattcttcagaaccaggatcgccagcttggccttcgggcagcagaagcaatttcaaagattgatgagatcagctctgacccgaatatgccaggacatgcacgcacccgcgtctgggaactggtctcacagcttgagactgtaccgctcgattaatttcaccatctgttttcggaggagagaaattcttctccagggcattttattcctagagaggagaggttttttggctattcgccaagtatggttaccgtaaggtgccgatcccgccgttccctggtatcaagttcaagaaggactatctgctgccaggttccaaggacaagagcaccattccgtaacggaattgtcagggacgggccaactagagctgctttcacatgtgatctgccattcccgtctccccagcggctgtcatgggcataggtgatatcaggcggggcagagaccgacaaagcacgtgagaggtcttttaaaacaccgggttcatactcgatggttgtcactgctgccgttgagccgataacaaacacatgacatataccggtttttacccctgatgaacaggcaatctcctgcaccttgtcagtgatatctacgatatccccttctcccctggttgaaagcgtaatagttccggatgttaccatatcatgacaatggtactccgcatgcaagatagtttcgaaaaaaggaacggaaaaaagattagtcaagtttcttgatgactttatttgcaatcttgagggcgcaatagtccccacacatggtgcaggcgtcggcatcggctgaggcacgctcatttctgatctgccgtgcccgggccgggttgatagcaagattaaactgagcttcccaatcaaggtcacgacgtgcatgccccatggcaaggtcctggtcacgcttgttgagttttatcatatcaccgacatgggctgcaatccggctggagatgacaccttcatagacctcttcaggatttggcagggcaaggtgttcagcaggagtcacatagcatataaagtcagcaccatgcatggaggacatggctgcaccaattgcagagacacggtcatcataacccggagcaatgtcagtgacgatgggtccgagcatgtaaaaaggcttattacccgacatccgcttcataagtctgacattagtttcgatctggtcaaggggcacgtgaccagggccttccacgatgacctggattcccatctcatgggcacggtcaccaagttctgcattgatgatcagttcctgtatctgtgcacggtcggttgcgtcatgaactgctccggcccgcatcccgttcccggttgaaagggtcacttcgtgctcttttaagatctcacacaggtagtcaaactctgcgtagagggggttttccttgtcattgtgcagcatccatgcagtcaggaatgcaccaccacgggaacaaagacccccatgtcgtccctggcgctggagccgttcaagggtgatccggtttacaccggtgtgaattgccatgaagttggttccaagttttgcctgttcctcggtgatccggaagaggtcatcttcccgcatatgaataacggcaccatctttcctggctgcctcgataaatgcctggtacaggggaactgaaccgacggaaagagtggtggcttctatgcaccgtcggcggatttcaacaaaatctccaccggttgagagttccatgatggtatcggcaccggcacgctctccggcttttaccttctcaacttccatatccacatcaacaatatcggtcgaggtcccgactgaacagttcaccttggtacgaaggccaccccctataccacataatttgaccttccggtagggtgaaaccggaatgacgatctggccgcttgcgatcccccgtcggataaaatcttcagtaacgccttcctgagccgctacgaccttcatttcttcggtgatgatgccttttcttgcatcctcgactattgacatagcctatatgttccataagaagatacataaaggctcttttttgcaaataagacatcatttttgtttatttgaaaacaagaaatgttgctttgccattgttacaccctgaatattctatagcagtgagatcaaaccttcatgcgtagtggctgaatcaatacagataaacttcggaggatttgtcccgttaagtactgtcgactggcggggaaaatccgtttgcgtggtttttttcagagggtgcccggtcaaatgctggtactgtcataaccaaagcatccttaccggagaggatcgaagacctgtcgaagaggtcaaagaactcattcgatcttcggcattacttatcagtggcgtcatcttttccggaggtgaagcaaccatgcagccacctgcgctttttgcgcttgccaggtacagcagatcaatcggactttccaccggcctgcatacaaacggtgtgtatccggatgttatcagaaaactcatcgatgaaaggctgattgatcatattgccctcgatatcaaggctgagtggaatctgtacacagtcagggggaaagagcgtgcggttggaaaacaggttaaggaatcactgacattatgtacagaatctcatcatgccggaacactccccggttttgaagtggtagtaacgctgtttcccggatatggcgaagagataatgacaatctctcgtgatgtcgctccagacatagatcttgtcctgcagcagggagtatatatggggatacggcctcttgatttgaataatctgaaagggatagcagaccggctgggccgaccggtcagaatacggacacggagtgatggagagatattttatgaaggtactcgcagtagttgggatgccgggatcggggaaaggtgaattctccgctatcgcacgggagatgggaattccggttgttgtgatgggtgatgtcatcagggaagaggtaaagaaccaggggcttcccccgactgacgagagcatgggaattgttgcacgggctcttcgggaaaaatacggtatggctgcaattgctcatgcgtgtgtcccggtaataacacggcaaagggcagatgtggtcctggttgacggaatacgcggagatgccgaggtgactctgttctctgaaaccttccccgatttctcccttgtctccatcgaagcaccactcaccacccggtttgccaggttatcagaacggggacgatctgatgacctgcaggacatcagtgaacttatcgccagggacgaacgggagtgctcttttggtctgggaagagcaatggaacgtgcatcggtcagaattgacaataccggaaccagagaagcgttccaggagagggtcagggaatatctgaccaggatgaaggctgcatgagtatcagatatttttttgggtcttcttcaaaggtctgggaagacatctcatggatatatggtattgaggaggcaggatttgacgggtgggagatctgtgcagacgggaattaccattttggcaaaaaagaccagtacgagagggttatcgaaacactccggtccacaacactgcaggcaacggtccatgctccttttggagacctgaacccggcggccatcaatgatcctatctggcgggagacgatcagacaactctcggagtgtatcaggctcgcatcagagataaccgaccgggtgacgattcatcctggatacctctcctgcaccgggaaactggttcctgagaagatatggcagctgcagaaagaggccatgcaagaagttggaaaggtggcgtcagaatacggggttattgcctgccttgagaacatgccagatattcatgactttctctgccgatatcctgaagagatccaggggatcatagaagatattgaaggggtctcgatgacaattgatttcggtcatgcacataccatggggaaggtaaacgattttatgaaggtgctcaaatccgcctcccatgtccatatccatgataaccacgggaaatctgacgaacatcttgccatcggagaaggcacaatagactggaacaagctgtcaaaagcccttctcagagactaccagggggttgtcgtggtagaagggagatccatcccggaagcaaagcgatccctggctcaggtccggaggtggacataatcgccggagagaccctgcagatatttttcctgggaacgtccggggcacttcccaccatatcccggaatcttccgtgcatcctcttaaaatgggggtctcatgacctgatctttgattgcggagaaggggcacagcggcagatgatgaaagcgcgtgccgggttctctcccgaagttatctatatatcccactggcatgccgaccattttctcggggttatcggccttctgcagacgatgtcctttaacggacgagagcagccattgatgatcgtcggcccggactgtgtgcatgagatggtgaacgatatcaaagggttgtgcaggaccaggctgtcattccccgtagaatcgcaaaaggtccgtgcaggtgatctgctcatctatgaaggatattcaatcagggtctttgcagcagatcatggtattcccggagtcgggtacatctttgaagagaatatgagaccagggcggttcaaccgggaacgtgccattgaactcggtatcaggccaggaccactctttgggaaactgcagcggggctcatcggttaccatcaccgtcgatggggaagaacggatcattactcccgaaatggtcatgggacccatgagaccgggcaggaaagttatctatacaggggacacaagaccggtcctttcagaacttgcagatatcggagatgatgcagatctcctcatccacgatgcgacgtttgaccatcaggaagaagaacgggcaatagagttcatgcatgcaactgcggcagaggcgggtatggttgcccataccctgaaggctcaccgtcttgccctcttccatttcagcacccggtacacgtctgctgataatcatgtttctgatgcaaaaactcatttttcaggagatatccttgctcctgatgatcttaccgtttttgatatcccgttcagggatgaataatttttttcaggagaaggccgacaaggaatactcctgaccgataacaaatgacagatctcctgaaataggagaaaggatgatactatcattactcatatgaaccgcttctaacatggaggcggcattcttctgacgcgaaacgttgcattccgccttcaatggagcagaattcttgttaattcctgctgacgggccggatctcactctggtgaatagtatgccaacaggaacagagacaatagtttacagccttggcgatggctgcagtattacagacatcgtcatagggaagacatataccgggacaatccagggttttgctaacttcggtgcgttcgtatatctgaatagttcaatcaagggacttatccataaatcaaatatgctgatgagtcaccgtgagggtgacaccgttattgtcagagtaggaaatatccgggacaatggaaatattgacctagaagagatcgtcatctcatcataccagattcagccggtcgtgtgcaagcgacggacaacaaaacttgaggatctgggggaaaaagtcggaagaaccgtcacgcttgagtgccaggttgcccagattaagcagacctcagggccgaccatctttacccttgttgatgagagtggcactgaaaacgccgcagggtttatcgaggcaggcaaacgtgcattccctgatgtaaaccagggtgatactgtccgggcaaccggggatgtgatgatgcgggggggccaggtccaggttgaactggcacggcttgaggtcctgcatggagcagaggcaaaagaggtgcttgaccggattgaacaggctattgatgaacgggcagaacctgcagatattcccatgttaatcgacagcccggtccttgaacggcttcgcccggagatgagaaagatagcaaaacagatccgtcgtgctgtcttcaccgcccagccgattctgctccgacaccatgccgatgccgacggaatctgttcagcggttgccatcgaacaggctgtcgttgctctcataaatgactctggcggggactatgatacggcgaattacctctttaaacgggctccgtcaaaggcaccattctatgagatagaagacatcgtccgtgacctggattatgcaacccgtgataacatcagattcggacagaagatgccactcatcatgctgaccgacaatggttcaacagaagaagaccttccggcgatgaagatggcaaaggtatacgggattccgatgatcgtctttgatcaccatcaccctgatgagattgtggaccagtatctcaatgctcatgtaaacccctaccacgttgatggtgattacgggatcacggcaggtatgctggggaccgagattgcccggcttatcttcccgaaagttgaccatcaggtgcgccatattgcagcagttgcaggtgtagcagacaggagcgaggcacccgaacggcaacaatacttggatctggtagcagaccggtactcagaggaggactgcagaaagattgcactggcacttgattatatccagttttatctcaggtttaacgacggaaaagaactcatcaaggacattctggacctgaacggggaccatgaccggtacaggaacatggttgatctcctggtagcagaagcggaatttgccatcggtgaacaggtaaagacctgcatgccgcatgtgatcgcttcaacccttccgaatggagcgcatctcttccagattgatgtggagattcatgctcataaattcaccttcccgccaccgggaaaaacatgcggcgaggtccatgaccggttatgccagcaatacgcaggaaaacctgttgtcacgctcggattcgggcctgattttgtggtgctcagatcgcggggtgtgctcatgaatatcccgcagatggtccgcgaactccgtgaagagatatcaggagcaggagtgaacggagggggtcatctggtcgtcggaagcataaaatttgtcgaaggaatgcgggaagaggttattggacgtttatcagagaaaattggagagtttccaacgacctgaatttaatcatgataaatcatgataattaaggtaactttaaattcctgcaatcgaatgtgtaaagtacgctgatggaggtctcataatgccatcacacataaaatttagagagaagtacaacgagacgcagtcgcggcttattacctatctcagaaaagggctcgaatcaggaagacattacttcaagtccaagtacattgcgaaagacctggggctgtcttccaaagaggtggggaccaacatggcaattcttgcagatatctgtcaggaacttaccatagtcaagtggagctattcaaacagcaccacctggatggtatccccggtaaagaattaaatccttttttcccgtacgcataagtatgaaggagatcatttcatttgaatcagaactggaatttgtcggggacattaatgagtttaaagattgcctgatgtcacaggacaatacccagcaagatccgaaggttctctggtttaacatcgatgttccgaaaggacatggacttcagccaggtgaccgggtaaagatcacggtagaaaaagtctgaaattctaaaaggggcgcgtggaaaatacacgctatcccaaatcctttttttataaccgggcgaacattacgcttcgtgagttctttttacaagttcttctttcatcttctcacggtttgatttccggataagataatacgcaatacccagggataaaatcaggaatccgagacctatgaggtgcatatcgctcacttcagaatcgagtaggatgacttttcgtgcaacggctgtcatcgctaccatgacgatcacttcaacatgaataactttatcgcgaagataggtcaggattgactcaaaaaactcaattccgatgagtaccaggaggaagtatccgaatatctggattatttcataactctccaggataaatccgccatcatcgacaagagaccagaatacagtaatcccaagattaatgaccgaaacgacgagaacgatgccaagcaggataagaaggaccaggtacatgatccgatgaaaggttttgatggagtcaatcatttcacacagattgtttttcaaggcaatgaactataccagccaaaaaaattttatttttccttcataaagaaggccgcaatgatcccgatgaaggccagcacagcaacaaccggaaacaccccaagataggaaccggttgcatcacggatgtatccggctatctgtggtcctgctattgcccctgctccataggcaagaaagatgacaccataacatcgcggatagtctccggttccgaagaaccgggcggtcgatgccggagcaattgcaagccagcccccaagacatccccataacaaggcaaaggcaatgatatagaccggaactgacgggatggatgcaaggagtatagacgctcctccaatgagaagaaacgaaacgattgccgtattccggggatttatcttatcggtcagggcaccgaagacaggtctccctccaccattaaagatggcaaagaacccgacaagcatggtcccgagtgctgcctctatcccgaccacctctgaaccgaccggttttgatatggatatcgccataagaccggcaaggcagccgataaaatagcagatccagagagcataaaatcgtcctgacctgaccatctccggcagggttatcgaacatgaggacccggcggtggcggcagaaccagtaaatcccttcggagtccagccagagggagggaatctgaacggtatggccaggaaaagagtcaggatgacaaatacgatgccaaatatcctgaacgttcccatgactccggtcatcccaataagcagccctgccagatttgcggttatgaatgcggaaaacccgaatcccagcaggacaagtccaactgcaaatccccgccgatcaggaaaccacctggcagcaactgcaaccggggcaccataggcaattcccacgccaagtccgccaatgacgccgtataggatgtagagcataagaaccgacgtggaaaatgacgccagaatccacccaagcccggtcagaattccgccggccatgatgatcttccggggaccagagatatcaagatactttccggtcagcggcattgctatcgcaaaacatgccaggaagaccgaaaagggcatgagtatctcacttgctgtcaccgcctgcccgagggtttttgtgaaatattcggtcagcggtccgacaaatacagaccatgagtataccgttcccaaacagagattgataaccatcccgagaaaaaccaggatccatctgcctttctctgcttccattccccatatacgagtattaccagtatcagtcatctttgattcatcagtcattttttacctcttgtcctgcttactcctccagcgtggaggtatcaccaagatccatgttcatctcctttgctttgaggattcttcgcataattttcccgcttcttgtgcgggggagagaatcgacaaattctatcgaggctggcatggcaatcggcccgatactcatcctcacatgataggtcagttcagacacaagcttctgacttggctcataccccttgaccagaatgacaaatgcctttaccgcctggcccttgatctcatccggaacaccgataaccgccgcttctgctactgcctcatgctctaccagagctgattcgacctctgcggtcccaagattatgaccagctacgatgatgatatcatcagacctgcccaggatcatgatgtacccgtcattatccttgacagccaggtctcctgcggtgtaataatttcgtatctgattccagtacttgcgataccgttcgtcattccggtatacggtcctcatcatagacggccagggttttttaatgaccagaagaccaccctgccctggtggcatactgttcccgtctttgtccacgacatcaacctcaatccccggaaccggaagcccggcaaaccctggtttcatcggttcaccaaggggggttgtgatcatgtgcattccggtctcggtctgccaccaggtatcaaggactggtatccggttctttccaatgacacggtaataccactcaaatgcctccgggttgaggggctcacccactgatccgatgatccggagcgagtcaaggttgtacttattcggccattcctccccgacccgcataaacatccggattgctgttggtgccgtgtaaaatatcgtaacgccaagctcttcgatgatactccaccagatgccaggatcaggccagtcaggagtcgtttcggtaatgaccaccgtagccccggcagagagagggccataaacgatgtaactgtgtccggtaatccagccggtatctgccgtgcaccacaggacgtcattctccttcaggtcgaagatataccgggcggtataatgaactccggtcgcatacccgccacaggtatggacaatccctttcggcatcccggttgtcccgctggtatagaggataaagagtggatcttctgcatccatctcttcaggtgggcagtcagtctccacaccatcaagaaggctataaaaatcctcctccatctcagagtacaactctaccgaacatttctcccgacagaggacgatgaccttctcaacacttggtgtgttccggatggcatcatcaacgatgctccgaagggagatgaccttaccccggcgtttcccgacatctgccgtgataaccacttttgcctctgcatcacgaatacgggcatggagtgcttcggctccgaacccggcatatacaatagaatgaaccgcaccaatccgggcacaggctaatagtgcgatgatatgctcagggaccagcggcatgtaaaaacagatacgatctcctttcttcacaccaagccttttcagagcatttgcaaaccgcatgacatcacggtgcaactgccggtaggtgtacacccgctcttcgccatcctcaccccgccagatgagggccagtttatttcttctcccggccttaatgtgccggtcaagacaactggtagtgatattcagggtcccgccagaaaaccatcgggcatagggataatcccactccaggaccttgtcccagggtttcatccattcaatctcccttgccatccggtcccagaaaccttccggatttttcaaaaactcctgataggcattatgataatcgcccaggtgtgactgggccttgtactccggatcagggagatatgatttcgtatgtaaaatgacctcaaaatcttcggacattatcctactccacgtagtatgaaacctgattgttcgtcgttcattccagggtacctcttaatcgtgccggtacatgttctcgagagtatgctaagcatctgaaaatagaaggtttgcgaatgaattaattttttgcattggtagtacagatacgttgtacattagaatatgaaaaatcaggctttattttaattaattgagataaatatgtaataatattatcatgataagaaggaattgagagtgcttcctcctgaacagatttatcagggagtaaaccggatgattatgtacgacattttcatcccagataccggggcagacaggagaagaaagatgattggagattacgaggagatccaaactataaaagaattattgcatggttctccacaagggctgtcaataaccgatatttcaaaacagttacatctgcaccggaccactgcagcaaaatatctggatatgcttcagatgaaaggagatgtcgatctccggatcatgggaacctcaaaggtataccacccatccaggcgggtgcctgcttcagtgcttcgcagtttttatgacggcccgttcatccttttcacaaccagactcaccgtcaaggatttctcatcagaccttgcagcatatggaattgaaggggatatcaccggagtggagctcaccgacaaggaattatctcccttgtatgatgaagcgatgactgaattatgcaagcgggcggtccttggatcttttgcagagatagatatcacaactcctgataagaaagaccagaaaaatctccatatccggatcatcccggtggtttttgatgacggacgggctggctgtgctttcctgattcaggatgtcaccgatcttgcccaagctcgaaaggaggttgagatctgtgagaaggaattgaagattgtttctgaagatctgaacgaatttgtcttcagctgtactcctgagggaattctcaaaagggtgaatcatcccttctgtgtcaggatggatagaaagccggaagaacttcttggattcccctatgaaccggttatatctcacgaggatcttgagcggctctcaaagatgaaacaggagattacaccaaccaatccgtcccagaccatctcatttaaggcaatacaaccggatgggatgatggcctttgaagaatggacctaccgtggcattttcacgcaggatggaaagctctccggatatcttgccgtgggccatgatatctcacgggaaaaacacctcgaagaacaactcaatacattccatgccagttttgaggccctggtaaaacaacgaaccaaggagatgcggcaggcaaaccaggatctgatgaaggagatagcacgaagagaacggatagaacgtgaactactcatcatcgaggctgcatttaaccatgcttccgattcaatacttctctttgaacgatccgggagactctggagggccaatgagaccagttgcagactgcttggatattcaaaggacgagatagcagcaatatcggtctttgatatcaaccaggagattactccggagatctgggaagagatgtgggagcaggcagagcaggaaccggggatatcgcgggtgacttcaacccatgtccggagggatgggactatcattccggttgaggtctcccggacatttttcaccgccggcccgatgacgctgttttgttctattgcaagagagatcaggtgatgggtccctccaccgatcaatatcgttaactgactgcatagctcattctgaagtagccagatgatacgcattctcctggttgacgatgaaccagatctccttgatctcgaacggcgcattctcgagcagaaatatggtttttataccataactgccgaatcaggaaaagaagccctggagatatttcagagtcagcaggtggacgcgatcatatctgattattccatgccacagatggatgggatcacccttcttcgaaagattcgggagattgatactgcaattccctttatcctctttactatcagggagaaggaggatatcgcaatcgaagcgatgaacagcggagcgaacttttatgtgcagaaagagaacctcccccaggttgtctttgccgaactggcccatgatgtcacaaaagccgttgaactcttcagagcagagaaaaatctgaagatacagcgtgatctagctcttgccaatgcgaatgccaaaagccttgaagagacgcttcttatctgcacccgtgccatcctcgatgtctccgggatggagggtgttgcaatctatctctttgaagagaaaaatctgaacgttgcaatcatcagcggttcttctgaacactattccagtaaacgggtccagtcagaggtacagcagatgcttcattcggtcattcagcagaagactccgatcttccgtgatgaagaggatattcgggcagtcactcccatcctgtttgagagtgagggtatccgctctgatggaatattcggaatgagtcatcatgggaagaccattggcggtgtgcatatcttcacatcatctccgcttaagacctatggcctctctcttcagcgatttatcaccgatatcgtcgtgcaggtatccgggtatatatcggaccggctcgcagaagaggcacttcggaccagtgagaaccggatgaaggccatgatccggaatcttcccggtatggtgtatcaggggcatattgatgaagaacggaccatggagtttgtcagcgaggctgtctttaatctgaccgggtactaccccagggatattatgcataacgccgttcgctcatggggctcctttatcaatcctcaggaccgggtcaggatccttgaggtcatcacccgggcggtccagaagaatgtgcgattcagactcacataccggattacgactagggataacaagtaccggtgggtatctgagcaggggaccggtatcgtagatgctgatggaaaccttgcgggaatagaagggatcattatggacatcaccagacagaaagctcttgatgaccaggtccggatgttccataccaggctgaaaacactttttatgctgatggctgcaggatgtcttatctttaaaagtgacgggaccatcaggaataccatacttgttgatctgaatagtgctgcagaaaagactgagcaaaaaaagaagactgaattgataggtatcacatttcagggattatttaaaaaggctgatcctgaattgctggaagctatcaccgggatgcttgaggataagaaatcccgtactctgcagaaatgtgctatcacctacccgtacgggaagcggtattttgatatctttctcagcagttctccggtgggttatgaacgaactgaccttgaaatatttctaatctataatgatgtaacaaaccgggtactgaccgagcagcagatcatcacatctctccatgaaaaggaacttctgctcaaggaagtgcaccaccgggtaaaaaataacctgcagataatctccgggattttaaaactccagtctatgagaatccaggatccccgggcagcggagatcatccaggagtgtcggaaccaggtctataccatggcatccatacatgagctcttatataactcaaaagatattggtaagatacaggtagaagaatatataagcagactggttgatcattttaaacaggaatatgaggggatatctgcacggctgaaccttcgtgtctcggttgatgccgatattgtgctggacattgagcggtgtataccatgcggattgattctgaatgaacttatcatgaatgcagtgaaatatgcatttcaaccggatggggaaggggagatcagaatttcatttacccaggatgcatcctcgtatcgcttacaggtatcagatgatggacagggccttccaaaggatttcgatgccagaaaaagccagtcccttggcatggaactgacctcccagctgacccaccagttacggggaaaactcgagattagcagtgagaaaggggcgacattcacgataacatttccaaagacggaggaaggcaggataaaaacatgagtcagcggcgtatcctgatcgttgaagatgaggcagtaacttcagtgatgctggagaaaaccctgaaagaactggggtatgaagtggtaggcagtgcctttgacggcagggaagctatcgagatcgcacgggaaaaacgtccggatctgatcctcatggatatccgtatccagggagacatggacggtattgagactgctaaacagatttaccagcaatttaatattccgagtatatacctgaccgcccattctgatgaagatactattaaaagagcggttgagtccggaccgttcggatatctgataaagccattcaaagagcgggaactctacagcaatattgagatggttgcgcacaagcataaactctatcggacgaccactgccagaaatgagcctgaagagccaacacaggttccggagaggagggtggaagagagaacgcctccagcatcagcttcagcagctgcaccccagcgaccacctgatttacggctgggcatccttgccgtccaggcaattccccatccgatcatcctgctgaacacgaatgggactattgcctttaccaatacggcattcaggaattttttccggatggtatcgggaagttatgattcgactgcatcaagtatagaggacctgcctgacctctgtaaaaagatctggatatctggaaaggaccggttcaaagaggggaagggattttcaatcaccggaccggttcaggtgaaagggacaccacgccggtaccgcgtcgatatgcttccgattgttgaaaaaggagtacttcattttatcgttgctatcatcctcccaggtgagaacagcaccgggaccgggcctggtctttcagactcctcaggaaacctcctcgaagaggtgattgataccatgaaagagatcagatttcttgcctcatctgaggagacctaccggcttcatcagatcgtggcacgggcagataatgtgttgaaaaacctgggcgagataaaacagatctcgtatccaggacagaccgagaagaaaagtggtcagatactgaccggataatcattgaggatcttggccggcagtctcatcctgatatgccatgaggactggggataatgctcctcaagaataagaagtgaacaccggtccagattaccaaagtgttcacggtcgaactttgtctcagcagccttgtaaaaggtcatgatttttttgaccgcgtcggtcacatcctcaccgacgatgatcttaccaagtttatctcctatttcaaagggaattgcgatctcatactcctccaaccagagaatgctcttgtcaacctcaaagaactcttttccgattataatgtaatggaactcgatatcaagttcaggttcatgcggaccggttcgtgccagcatattatataaaaaatccagaagaacccgtttattcgagatgagatctgatgagatggcttcttttgagagacggcgggccatgtcaggaatgatctgttcccggtcgatcatcatgagaaactgctcctgtgacctgatagtattggccataaccttcagtgtcaggaactgttcccgaagtgttgacccggcggttcggcctatgttgactgccatactgcagagatatttcttccttcataaaagatattagcatcggatcataaaatatggaatataatttagagttagatatatagcaacatagagtttaatatttaaagcaatgcacgaaatcgaaaacattgaacctgaaatagagaccatctgaaaaacggatttattagaaagaaggtaccagagctcaggacatatccatctcatcaaggaatggaaggagtccgataacccgtggtttatctccggcctgttcaatccttacaatggtcactcccaaggggattgagctgagagcatcattgaatgaaggattcatctcccgttgaatctcaaggaaaagcgggagcggaataaatgggcgttcatgttcctcaaatttcccatactctcttaaatccttctcataggttgagttatatgccaggtctttctcaaaataaacaattatttcacacggttcccggactgatatctgctccaaggccctgatatctgctaccataccagtactcaggctggataggacaacagggaacgcgggtattttgtctttcattatccgactccctgggtatgaatcgcttctattacccgttccagaacttcacgacgttttttggactcttttttcatatcacggagagctgagaccatctcttcctgcatcttcagactccgtttctggagcttaatcatctctttcagatactcaagccccagttctgaccggtgaaacatctctttttgaaagtcaccaaaatggggttcaaagtgatcgaatgttccttcactggctgactccgtgacgctgagagaatcaatccggatgaggggctcatcctctgctttaagatcctcacaaaagcgggctagaccttcttcttcaccctcagcaacaatcctgaccgagccatcggagaggttctcagcatacccgaaaaccccgtgccggttcgcaatcagtctggcaaatcctctgaaaccaacccgttgtacccggccggttaccagaatagtatatcgtctctgcataggctgtgattgtcctatgctgagacgggaaacgggtttaagatttcgtttccttttgccctggaaagaggaggtgaagatctatctcaattccgataacaggctgatcaatatcaaatttgtttaatacgccggggtggatctcgccaaatacacccatcttcttcccgtcaaccatgatatcaacagcacggccggggatgaatgctggatcagcactctccgccggcagataggagatcccaagttctctcattaatgcatctgtcgttgcatatgcctcagagaagtctgctccgggatgggttgacgcaagggctagtttctggtatgtctgcatggaagagacaacatctccggtgtggaatatccgctgggggagttctcgacgcttgttcatccgaagcagatccagaaggagcggaaggagatcggtcctgaccagcgtctgctcttcagatatcggatgcaggacatgaagtgccttcggatcaggctcccgctgcatccgggtatacatgacatcctcatttgataatgtgaacggcataacctccagatatcctaatccagagcatatatcccggattgctgatgcaagggcgataatggggtgttcacatccggttgcaaaggttgccggaagctctgcctcaaggttaccaaaaccggcaccgatggcaacatcctcatacacatcccactcatgcatgatatctgcccggtagcagggtatccggattgataccgtggaatcaccggatttttctgctccatatcgcatcttcttcaggatggtcgcgatctcatctgcggaaaaggaggtcccaaggagcttattacaggatgtgacattgatatttcgaagtgccggagagaggtcgggcatgacgacaccgttcaccgtgacgctttcacatcttcctccggcggtgataagggtggtacagaggaccctgagagctgtcataactgcacgctcgtcagtcccagtcacatcaaggaggaggtttttcgatgattcggtaacccgggttaattctccgttgatgatcggagggaatgagaggacattgccgtttgcatcctctataagcggcatgaccggcttatccttcacgatgtgggagtagtcacggcctttcgggtgctcttccatgatttcagtcagggtcatctcccggtcataatccaggggaataaaggatcgggtcaccggggcaccataataccgaaatggcggggtcactttgtcaaggtcatgcacgcctatggctacttttgcccggccacggccaacaacccagtgcagagcttcctgcacgcccatgagactgatgatcgcttcattgtccagctgaatatccctgataaccgctgaaccaatgtatggtctgacttctttcaggttctcgtcgacggagaatgtaatagatgaaggactgaccggatagacttcttctccggtctcaagttcaaggaatccccgcatggcccgggcaactccttcggttgagtagagatccacccgtgacggaaaaaactcaacatccacctgatcttcaaggatacgctcaatatctgaaccgatcatgggaagatggtcaatgatggtctttcggtcaatcccacacaggcgttcaagatatttgtacggaagtgaaacaaccggcatcagcaccgacctccctgaacgaccggcacatttctgacccagtcaatatcactctggtagagttcacgaaggtcagtaagccccattctcagcatggcaactcgtgagacaccaagaccccaggccagaaccggacaggtgatcccccagggtgcggtgacctcttcccggaagataccggctcctccaagctctacccagccaagaccctctatatatacctcaggttcaacgctgggctctgtgtaggggaagtaaccaggtctgaaccggaccgattcaaatcccattctgccatagaactctttcaggtatccaagaaggttccggaagttcacatgagtgtccatgacgattccctccagttgttcaaactccggaagatgggttggatcgatggcttcccggcggtatacccgaccgatgcagaaggccttcactggtggctccgggtgtgcagcgaggtgttgaatagaaagactggtggtatgagtccgaagcacggttgcttttgccttttcaggatcccattttccgccccatccggttgacgaggtttcgcctccagattcatgcatatcacggactttttcccagccaaccgggagctcctgcttcccggcaagatggaacgtgtcctgcatctctctggccggatgatcctgtggctggaaaagggcatcaaaattccagaaagctccctgaatgatgctgccatgtagttcggtaaaacccatatcaaggagaatccgccgcatctcatcgatcatccgctggtagggatggatctttccaggccagaccgggcgggggtgcttggtgatgtcataccggcgaagggagagatctttccaggcacctgaactgatctggtcagcagtcagggtcccggtctcttgagtgagtgtgatcccggcagcggcgagtttttttccctcatcggtgatagtgatcgtataccggactgactcttcttcggtaacaaggccacgtttgagaagatccttcttgatgtcagctggagcagcatccgggtttttcagagcgagctcaatcggagacggagcaggatcaccggtcttgatgacatttccagcttctattttcacccagccaagccgtttcatccagccaagaccgatctttgcatggggatgggtattaaggtcagctatggatgcagattctgaaaaactgtcatagagctgccgttcaggaagtccctctttcaggtactgagttccttcctcggtcagagtaagtgtcgttgtgaccgcacgatcaacctgtgcaaggcctttctgggacaagagtcctccatattgaatgactgaatcagcaggccggtcaaggattgttcccatctcttccggagtcgtggtttcggtcttcaccagctcaagaagcagacgtttctcgttcagggttaattgcatgatatctccacatgtgatccaattgtcagtttctgtgtatggattggagtttgagttttttgtatgtgctgcatgaatatatctcctgataacctatgctaacagtaatcgattattacaggggcccggtttagtccagacccctatctaaacgaaaagaatgagcaggaaaagaatggagagaatgatccaatagtgctcatgaaagtctggtatagtgtttcctgtgattagtatttataggatggggatctgaagaagaagaaaatttcatgtctcaaatatatccggatcaagctttgcctgcttcaaaatcgagattaaggtcccttttttaagttaattatgaaggggacagcaaatgattgaccttctcgctgtaaaaccgcatgatcaccacctattcgtcgaacaactgctccatgatggcagagagttttaatcaattcctttccggatatgacagggagtttatgagacatgtgctatctctatccgggcaatctgagtcgttgatagagcgagcttatcttttaaatcatcctgaagtacatcgagaaggagttcaattgcctctttaatattatcaagcgcctggtctacagtttctcactggcttatcgctccaggtaattcaagacatagtacggtgtatccatcttcttcctgaggcattatgagaattgtgtattgcataacactaataataatcgcattttcaatagaatattgatatctctcatctctatgacaaaacggaataacatttttgttgatacgagaactccctatgccctttttaatgagaatgatatcgaccattcatcattttcatatcacaacgtggtaataccactctgaaaagagataccacatggaaaaaacggacttcaccggctctttagatacctggtgacaggatgagttgggaacgagaaagaagctaattttttgcgaaacgagggattaccaccttatgggccggttccttcggcaatcaatttcacataatctctgtagagatatttcctgttccgcttccatccggtaacctcttttactataccagcctcttcaaatttacggaccaaattgtttgcagtctgtattgaaacaccgcaatgggtgctgatatcagtactggtaaccattgtcttcataaacagaagttctatcatccgggcaccatgaataccgccgatattctcgtaaattacccgtttcaccagttccctctccagtgttattatcttctttactaaatggtgcgaatcagtggagacttcaataactccctgcagaaaaaacttcacccatccctccagatccccatttttttccagtgaaaataaacgatcataatattccgaccggttccgtttcaggtaataactaaggttaagtgtgggttttgcaagaacctgtctccaacagaggtacaggctgatgaggaggcggccgattctcccatttccatccaagaaggggtgaatcatcttaaattgtccatgaatgagagctgatacaattaacggaggaatggttttttcttctgcgataaaattttccaggttattcagaagaaatctgacattttcctgtggtggtggaatataccgggctttatagagtgagtctcctccaatctggttttgtatgggccgaatcatccctggcagtgcctttgatccccgaaccttcgtaaggaggatccgatgaagatcacagagtagtgagagtgtaattggttcatttttcacccgttcgaaaccggtctgtaaagccttcatataattcgtaacttcccggatctggtttgggtcatcatcaaaagatacatcagcctcatatgcgagaatcccataaaatgttgcgaccgtcccctcaatctgggcactttgcaatgcttctttcctggcaagcatccaaataaagtgatccgggtttgggagcatatcaaccatgacatcaagtcccgataatgcccgatctgcttcagaaagcatgaggtgcatggagtcatcatattgaatatcaggtgagtacggaagacatgcaggaataaacgcggtatacccttcaatctgctcttcatatctgccggtattataatgcatgtatagccacccagtttgtgagcagatcctttcacatacacccatgttaggaattatatgaagcctgcctttcatataatgagatcatacgagtatgtgaaaccttcctttcatacgtcctccccaggattgggatctcaggataccagaaacattattgagatcttacagtgtttcccgtcatgatcctaaaagccatgatcagaaccatgatctttcaagtggtaagcaagtcattgatatgatctccgggttccggaacccctcagtgattcatgatttcaaaatgccgataaatgtggagtttgtgaccactataccgtagaatgattcattgtttccaaataaggatgaataatcctgaacaaggaaaatacaacaaaaaacagataaaaggttccctttgaaagaaggggagtataggaaattattaacaactcttttccgatcgtatctgatctgctgcaaccgccatcttctccctgaactcatccaggaatgccaaaaccctcgctgcactatctttcttacattgcccgcacatgagttctccggccatgcatttccgacggatttcagcaagctctgcatcatcagataccatatgaaacagatttaaaagaaacaccggacacttgtctgcctcccctcccagctctttctgttcctggagtgtcatccggccaccggtcagggctgccatgatctttctggtgactgtcttgtcatcctcataaaacccgatgatactctccggaatactggatgacatcttcccaccggtcagaccgggcatgaaccggtgaaaggttgcggacggagtgacaaacccatatcccccatgggttcgctctattgccctgacggtctttttcacaacatcaaggggaacattgaagatatctatatgaccctcgtaccgcttagaacccctgaatgctttatgaatcgcttccatcgcctcttctggggcttcttttgaccggacactgacatgggtgtcccgatcttcgacggtgaacatccgaagtttatgagctactcctcttgtcagacggatatgcggatcctggtcaagccccaccggcacgatggtcggggccggctcttcattgacctgcggatggagaatatctgcaacctgggttaagacactcatggcatgaccgatatcggtatcaggagtaaagccataaattgcagagagttcagaaaaattcacctttgctgatgcttcaaatgccagatcctgcacgacccggttcgagctctgctcataggtttccccatgatacccaagagcatagaggcaggagaggtattcatcgccatatttccggcactgttcccaggtgaggtttcgtactgcatgggcctcccggtctgcgatgcagatataaccccgtcctccctgctgcacatgccagaccacttccttcatgaccatcaaatgtccgagatgcgggtgaccggacggcataaacccggtcatcacattaaacggttcattggtcctgattgcattcgctatctgatgataatcgcggtggccgaagacgatcccccgtctgataaaatcgggagtctcgggaagaagatcaatgacggtctcgatccgttcaattccaaactcggcatgcagacgctcgatatctacagactggtctgatgcccagggatttacaacttcagtcttcatggttctagagttttatcctggcaaattctgtaaagacaatgccctcatcatgtataccggcaaataacatcttctttttgacactgtgagccatccggactgaacgggatatactattcatcgggagtgtctccaagggccctatcgcctggaccagcatctctgagtggatttttcttccagaatataccctgaaatgatggccgaatttatacccggtcttggggatatactggagttcacgtaaatagcggtataccgtgatctttttatccagctctgggtctgaatcctggatacgggcacaatattcttcggcagtaagcgtagcctcgcccagctgaatggtgacaagaccctgttctatcaggtatgcagcttcaacggttgagagaactatccgtgaatcatccagccgttttccgtaaaatgcctgatcatatccaaggtctgctcctgcgttaatgataaccgatatactggagaggaggccgggtgcaggttttgggtccggagttacctcaagtccggggagtttctggagttttacttcatagtatgttatctcaaactcgtcatcaactaccgcaaggacatgctgttttctcatattaagggtagtcctgacttcgccctggacaacggaaaagtcgatcagatcacgttcagagagcacgcggaccatatactgggactctccttttcctggtttttctccccgcttaaataccctgaagtcatgagggccggtctgaaccacatatccccgctccctgatatcccggtacaccaggaacgatctgatcatatgggcgttatctgaaaacctgaccagaagcgtgtcaaaatcatatccggggatctcgattctcccccggtacacgagatagagtgcttctaccggagagagccgaagcccgtccttttgtggtctgccaaatccgctctgctcataaagggcatatccttctgaccccagcaggactttgtcttcttctatccgtgccttcacgccttaagatttaggcgtcgtccatcataaaacagccccggataccggattggaatgagtcagattattgagaaataaacttcatgatgctatatataagtggtgaaatattcaaagagacaaatatcagtatccagggatgaactggaaaacagaccgaacaggaagaaaagcaatactgatgtgagcagtgagaatgaaaagagggtcaggactagatagactctgcgttccgacgatgcaggctgcttatctcatcccgaagtgacgtaacatctgaaggacgatgagaatccctgatatcaacccggtctgatccttctgggatgaacatggcatccatcagcatctccaccccgtcatacaggatggtgaatagttcacgaaagggaacacccgtgatgaacaccgacttgaaccgatcacaggtcggaaagatcttccgaatctcatgagcctcgctgatgtgtgaaccgatgattctctcaggactggtcccgatatctccaaaaacaagtcaaaaatttcaggaaataggattcggacacaacggggaacatatcatatcgtttttgcagagaggataattgtatttctggtaaatcggtaagaatatgtgaatattcatacgcggatcgtctcctgggttaaggttgttttttttacccagcatactatagagatattgaggaagttcgcgtacatgacgaacgaacacgggtataaaacaaaagaacatctaaacctgaccggagaatccgatcttaccatcgaagttgttatcctgctcattttcgggatattcatgcttattttcggccttctgctctttcagattcacaccggtgctcttccctatgcaccggacagcacatatggattatttgtattgctaattgcatttcagattgtcacgatgggaaaaacgccttttggtgatctcaaacggtcctggcttctgatacttatcggcattatcgttgcgatcctgggaatggctgctgcttttgtcccgggatatctttctgaccatatcaggctcatcgtcggaggggttctgtttctcggtggtgtagctcttttcctccaactcttcgtgagggaagacaaagcccggacctggaggcatgtatccggagtacttcagcatctgatccttgcctgtgggctggtgtatatcttatcatgcatatgtggcctgattactcttatccccggaattacgacggataatcagactgcagtcattttaattctgtttgctctgtgtcttttttacctttcatggtgcattcagaaggttgcacgagagtacccttcgaaaaagcaggatgtagaacatgaatccgcggaaagtgcagcacaaaagacaaaagggatatggctggttctgaaagagtcatctatctcactctctctcggggtccttcttctggttgcaacactgctgacccttcttgggttggttttgatcccggtaaaccttggggcactcccgttttcacaggacggactgcttgggatgcttctggtcgtgtttgctattcagatgatggctcttggagaaaccccgctcggggcatataagcgctcctggctgatgaccatctttggaatgacattcgcaactcttggtattatatcctgtattgttcccgggttactgaccggttttcttcaattactcctaggtctgttaaatatcatcggtggtgttgtcctgctcatcggccggtattacccgcttcttaaggcaatgcgaaacccttcggatcatcagaagcagcccccgatactgaaaaaaatgaatattacccagaccatactgaattttgtatccatagcatttggtacatcaatgctcattccgggtatcatgccaggactcatcaatgccgtgattatcgtaataaacggactgctcctctttgttcttgcaggtttcatcaggaagattgaaatcctctatccgatgtagagggaaaaacaatagcatttttttgagtacgagtgaaaaacatataccatctcaccgtatggagttgagagataacccgtaaattttgaagaagacttttatcctattcactctaatgttcaaatattatcgaaatgtgtacgccatgatttagagggatagaatgaaaaagatatcattgaaaccaattttcaggatgattgtcgctcttttatttgtaggtctggcaatctccttctttccggtgtcagcggccatatttattgaagatgggaccgaactggatgagtctgcattgatcgcatatctcaaagaacctgcccctgaatttgaaactccgctcgtgatctacttttatgatcccaactgtggtggctgtatgcaggtccgtgacttctgggatacgtacctgaaagaaaaccctgatgtcatacttgaacaggtcaacctggaggaaggccctgaacagatggatcagtttaagcaatttgccgagacctatcaccgggaaaaagcctttattccccttgcatatatcggcccggtctctttggaaggggcagatgatataaaaaattattttgatatggtatacacctggtatatgtcctcatttaaaggagagtaattctccgggtctttttttgtcattgtgagttaaaacgagaagcaggatactgtggataccaatgatatgataatggaagcgctcatatcatccataggcatatgttcgaagaatttatcagggccaataaatttgaccaggcatatctcccggtcctgcagaaaaaactctgctttgagggtgaatgtgcaggaaacgggattctgaattacggagtcctcctgaccctcgccaccatcatctcaacgtatggggtcatagccggatccactgccacggttatcggagctatgataattgccccgttaatgaccccgattatggcaaccaccctcgcaattgttcttggagacacgcaccgtgccggacgatcatttatgatggtgacggtcagtacggtatttgtcatcctccttgcagccctgatcacctgtagtatctctcctttgaccattgatttccagggaaatcaggagatcctctctcgaaccgcaccagatatgtttgccctctatgttgctcttgcatcaggagccgcaggagcctttgctgtcagccgggaatcagtcagtgactcactgccaggggtagcaatagccatctctcttgtgccaccgctcagtgtcgtcggaatctcactttcaaaatttcaatggggagatgctattggctctctgcttctctttctcacgaacctttttgcaatcctggtctccggtggagcagtattctggctttcaggcataaaacccggatggatggacgaagagcgctcaaaaaaacggaaacaggcgttttccatagccgtcatctgtgtagtcctgatatcggtcccgctttttatatcaggatatgagacgttggagcaggcatattactcgaaagaagcacaggaaattacaaagaactggctgtatggatccgggtatgagataacagattttgatctccgcaaacagaacctgaccctgcatatcatcggaacaggagatatgcctgaccctgaactcctgcaccggatgttggaggaccattttcaaagacctatagccattgatctgcgggcaataccagtgaatataattcattacccctcgaaaactgggtcgtagaatgcgggagttttatccacttatccggagtatcattaccagagagatagtatgaaaaaggtaaccggagccattctgcagcgggatggaaaaacatacgggattatgacccataccccctctggtatagtaacccctgaggatcttgaacgtatcgccgcagtcgggagaagattccacattccaatcatgaaaattacctcaggacagcggatgattcttgctggaatacccgctgataatgttgattcggtaatgaaagaacttggaacactcggaaggccagaccttgggccaggtgtgaaatttgtccaggcttgtcttggcatagagagctgtaagtggggatcacaggattcaattggccttgcagccaaaattgaggcctgtgttcaggataaaaaattcccggcaaaagttaagatcggggtatcgggatgtcaacgatgctgtagtgaaagtcatctccgtgatatcgggcttatcggaaccaccaggggatggattgtcctttttggaggaaatgggggaaaaaagccaaggttcgccgacccgatagcatatggtttgtctgatagtgaagcatgcgatctggttggacgcctgcttgaattttatcaaaaaaacggagaaacccaggaacggactgcccgattcatggaacgtatcgggatcgatacattaaagtcagagctgctctctatgatcccttacatacatctggacaaggtgtaaccatgatcataaccgacgtagcacaggttgtttcaggaccaaatccacaccacgtggatgccagaaagatctatgactctccgcatgcaatggcggtggtcatcacccttaagccgggagaatcactgaaaaaacatattactccggtcgatgtcttcttttatgtccttgaagggacaggaatcgttgagattggagatgagcgatcagaggtaacaaaggatatgctggtggaaagcccggcaaggattcctcaccggtggattaaccagagtactgaaattttcagagtccttgttgttaaagtcccaaaaccaatagaagagacgaaattactctgaccgtaccatcttttcaaagggtgcagtatgaacggcctgttatttcacaatcctccatccacctttcggtacccggatctcaaataaggctccctgcccttcctgccctcgttcgataatagaaattccggtaagtgcaaggatctcccgtactagaaataatccaagcccggtattattcccaaatccccgctcaaaaattttttctttacattccagaggtataccaacgccgtcatcggcatacgtaataaggaactcatcaccggatctctgtgcagatatatgaattgaagtgaccgtttttccatgcctgatagaattatctataaggttcaggaataccctggagagcatctgatctgcatagaggtagacatcaggaagatcgagaataatccgaatagactctggcagatgagtttcttgaatacaatgtatcagagcctgccattcaggttcatgcaacccaagaccctcataggttttggtaaattctatgtgagactggattttttccgtacatgccatgatattctcaataaactcgtcgattctctgatcatgggccatagccttcatcgcatcaagatagataaaaatggcattaatctggtttaaaatgtcatggcgggtaatcgaactgagcaggttgagctgacggtttgcctgaaatagtgcctcctctgacttttttcgttcggtgatatcatgggcaattcctaaaaatgccttcggagtcccgtcaggatttctaaccagagttacgcttgatacatgccatttccatgaaccatccttatgcctgacccggtattcaacccctcccatcttttgcccggtactgattattgtctccaggaactggcttgtcgccccaatatcgtcagggtgaacaatatttgtatatgaactcccgataatctcctgtgtattatggcccagcacatcagcccagtttggtgagatgtacgtaaatactccatcgggggtaagtgagtagacaatatcatacgcatattcaacgaacgatctgaaccgctcttcacttgcctttagctcctcttctgcagctttccgatcagatacatcacgaattgaaagaagatccgcatcctgaccctcataccggatcagtttcccgacacattcaacccatatcttctctccatgaatggtacagatctgatactctgcaatgaatggatcgattccttcccggacccgtgagagatcctgaagaacctgatcccgcgattccggggcgatgaaatccataacatttacacctgaaagaagggccgggtccgaaacccctacaaggtggagtgcagctatgtttgcaaataagagcttcccttcaaaatcaagaattacaattccttcaagtgaataactcaccagtgaccggtatttttcctcgctctcaatcaatgcagcatatgcttctttctctctggtaatatcagtaataacaccaaaatatttcaggttcccaccggtatctgtaaccggtcgtgttgaggttctgacccaggataacgatccgtccttttttataagtcgccattccaatggtttcaatactcccttttccatttcctcaaacctcttcagaatagccgggcgatcctcttcatacaccatatccagaaagaaccttccagcaagatcagcagagcggtatccaaataaccgctcacctgcaggactaaaataggcgatctggcctttcggatttacagaaaagatgacatcgttaatattttcaacaagcatcctgaacttggattcactcagacgaagtgcacgctctatctttttccttccggtaatatcctggattattccaaaaacggtatgagatgcaggatcatattctgcgataaaatggacgtctataagggcattatctgtcggtcttcgtattttacattcttcatttaaggttcgttttcgaagaataaaatcctgaagggatgcactaaaacgggacctgtcttttatgagaagcacattgaggaggtcatcaatggtaatcttttcagtattgcagccgattatcacctgggcaccaagtgatgctaatatcattcctgaatctggatcatatgtccagtgacccagcccggcaatatactcagcatggtacagctgggcaatacttttctgtaaagcctgttttatctctctgccttctataatgcgattgataacatggataagccgtgttcgttcaaaccggatatcaatataatccgtcagacagagatctgccccatacgagagggcatcgttcgcaatatcctctttttctgctcctgtgtagaggatgaaaggtagatctccgaataattccctgacatgatggaggagatcaataccattcatctctggaagatgatatgccgcgagaaccccatcatatgatacggattttaactttgaaagggtctcatgataagtcagagaaaaatccaaggatatatttgggctttgactcaggatttgtatatacctgctcaagggtcctttcccgtcaccaacacagaggagagagatcatacatgcccgttgcaatatttttatctactgatatcacccaatatgtctcatcaaccataataaagataccctaaaaatcccatgaaaagtggttttttctgtgaggtcatcttttgatctcttttgaatatgagaatcatttcaatacctttcaggaacccggatgagatcagagagatcagatgtaaggggaataccctctgattatagccattcttcatcattctaccagttcgtgagagtgatcagacacaccaggacaaggaacgagtatgtatcagcctccggtacttattaacagagaagcctgtacagcctgtggaatatgcggtaaagtctgtatgttttccattataataagcgatgaatccggatctccgggtctgaatccgcatgctcctccctgcagccggtgcggtcattgtattgtattctgtccttcatctgcaatacaattgtccggttttggagaaagacaaattgtacccgtgctgtctgaaaagccggttactccagaccagatcaaaacccttgttacctcccgcaggtcaaccagacagtacctgaaaaaagtcattccccgagaggtttttgaaaatctgtttgatatcgtcaggtatgctccatcagcaatgaaccttcagaccgtccactggcaggtcatctatgataccagcattgtggggtctgttggatcagcaatcatctcatggatgaaccggatgatagaagaacaaagacttcatgagtttgctattggttcatcatttccctatattaccagggagtgggagaaaggaagggaccttatcacgcatggggctccccatcttctcatgacatactcaggagccagtgaccctacagcaccaaccgatgccataattgcaaccagttaccttgagctgacatctatggcatatggtcttggaacctgctgggccgggataataaaacgggcagcagaatggtctccggaagtcaggtctgtaatggatcttcccgaaggcaccatccctcaaacggttcttctcatcgggtatccggctttacggcactatgccatccccccacgggaaccagcgaggattcgatggaacgggtgaatttccatgtatgttattcataccataattgaaaatgatcgacattcaaatagagccacgctatccactttttggaacatacccctatagaattacactccggcatcagaccagaatagcacccctctataaaaacaacataatcgtagatcatcgtaattgaatcaagaattaaccataattttttctgcgtgcatatgtaattattgagcgtatcaaataaaatttattttcctgaaataacagcaatttagctaaattttctcgacacaaattctctagagcagaacattttgtaagatggggccttttacgcataacggggaataaaaacatcgacaattcacgaatggtctcttctttcgtttcgaattaaaataaaaacacataaattacctttgtattcatcttgattcctaccaactgtcatgataaataatgataaatatccatgctctcaaacgatacatacatggaactgctcatcttcctgatactctttcctcttctgatggctggccttttgacactcattcagggcgagaatttcagaagagcggcagttataagtggagcagtcctggttgggattgcttctctcattacccttgcagacagtatcaccacccaggcagtataccactctgttccggtcgatatgattggtatactcatatttattggtgatatcctcattagcgggtatatcatctttgtcagtctgaaagcacggcagtatctggtaaccggcatcaccatcctgcagcttattctcctgtgtgccgtcgaatatctggcactcgcagaccatgcccatattcctgaattattttcagatcaactttcaggaatcatggctgccattatcggagtcattggaggccttatctgtgtatatgctcttggatacatgcgagaatatcatgcagagcatccggaccgtccggataagaggcccaggttcttcggaatcatgttcctcttcctttcggcaatgttcggagtggtcttctcaaataaccttctctggctgtttttcttctgggaaataaccacactctgttcattcctgcttatcagatatccggagacggatgaagcggtaaagaatgctttcagggctctgctcttcaatctggtcggaggagcatgtattccggttgcgttcctggtaattttcctaggccagggatcacaatatatcggacttcatgaactggtaactgcaggacccggtattgcccttattcccgcaggactcatagccattgcaggacttgcaaaatctgcacaattccccttttcatcatggcttgtcggagcaatggttgcaccaaccccggtttcagcccttcttcactcaagtaccatggtaaaagcaggggtctatattattgcacggttcgccccggtctttgaaggacagattgtagggatccttattgcgcttatcgggggaatcacgttccttgctgcatccgccattgccatttcacagagcaatgcaaaaaaggtccttgcgtattcaactattgcaaatctgggactgattgttgcatgttgtggtgtcggaactgcagaggcactctgggctgcaatccttctgatcgtcttccatgctattgcaaaatccctgctcttcctctcggttggaacggtggagcaccagattcatagcagagatattgaagacatgaacggtcttgtcaccaggatgccccggattaccatgattatcctgataggaattgccggcatgtttctggcaccgtttggaatgctcatctcgaaatgggcatccctccatgcctttgtggaatcagttcctccatatggtatcctcctggttatcatcatcgcgtatggcagcgggattaccgcctttttctgggcaaaatggatggggaaactcatcgccgtcggagaaccacagacaaaagacgaatcccatatcccaagatctgaaaagaacattctctatattctctcagcacttaccataggagtctgtttcgggtttcccatcatctcatggtacctgattgaaccctggctcctaaccatgtatcagtcggtcacggatctcatctcactgagcaatatcgagatcatgttcatgatgctctttttagtgctcattatgccgttttctctcgcccggttcacgcattcagcacgacgggttccccgatacctgtgtggtattccggagggacggagcactgcattcatgggtagttgtgggataaaccgggaaatagcactctcaaattactatcttgagcggatatttggtgaagaacgtctctcccgaatcagtgtggggatgggtatcttcctgatagtcctgcttctcaatattcttattatcggaggtggcctgtgaattccatggatccgttcattgcagcagcattgtttatcattcttgcaccggttgtcggcatactcatcaccgggctggaccggatattgactgcacggatgcaggggagagtcggaccgccggttctccagccctggtatgatatccgcaaattattccagaagaaacaggtcgcagtatggggagcacaaagctttttcatcttctgctatctcatattcatcatattcaccggggcactcttctttgccggaggggacatcttactggtcatattcgcctttacccttggccatgtcttcctggtgcttggtgcctatgtatcgtactcgccctatgctcatatcggagctgagcgggaacttatccagctgatggctgtcgaaccgatgatcatcatcgcagccatcggactttaccaggtgaatggttcattcctgattggtgatatggcaaaccatcctggtcttcccatactgcttctaccgggcgtatttctcggatttatctatatattaacgtttaaactgaggaaatcaccctttgatctggcaacctcacatcatgcacaccaggaactcgtaaagggaagtacgaccgagttttcaggctggacccttgcaatggtcgaacttgcccatatctatgaacttgtcgtgatgctcgggtttatctggttattctttggggataatctgatcctgtgtgtggctgcaatagcaatcatcatgatccttgagattctggtcgataactgcacatcaagagtccgctggcaggatgccatgaccagtgcctggtttgtcacccttgttgccggagccggaaatatctttgccctttcaattatgtgagaatcatgtcatacctacagaaatcaccctggataattcattatgatgcctcaagctgtaatggctgtgatattgaggtactggcctgtctgactccactctatgatgtagagcggtttgggattctcaacactggaaacccaaaacatgctgatatattcgtcataaccggtggtgtcaatgagataaacaaagaagttgtgctgaacatctatgagcagatgcctcatccgaaggttgttgttgcggttgggatctgtgcatgctccgggggagtattcagagaatgctacaatatttcagggggtgttgcaacagtcatcccggttgatgtctatgtccccgggtgtgcagcaaggcctgagtcaatcattgatggtatcgtgcaggctctggggatacttgaacaaaaacggagtgcgatgaaagcaggagcggagggagtcgcatgaagcagccacaacagacaatcaagaccatcgcagtggaggaactcattcaccaggttcattcatttcatgatgacggatatcgcctggtccagatcagttgtgcatcggaaggggatgcttttgaagtgacctatagttttgacaaggatctgacactgattcaccttcggatccctgcttccactgaaaaaccaatccccagtatctcaaggatttatcttgccgcattcgtgtacgagaatgaaattgcagatctctttggaattcctttcagcgggatagcaatcgattacaaaggtacctttatcaggaccagtattccccacccctttggatcgccacagatttcggttgtgaaaaagaaaccggagggccagcatgagtaaacagattatcgtcccgttcggacctcagcacccggtccttcctgagcccattcatcttgacctcgtcttggaggatgagcgggtcgttgaggcaattccctccatcgggtatgtccaccgtggtcttgaaaaacttgtggaaaagcgtgattacaaggactatgtcttcatatccgaacgcatttgcggtatctgcagtttcatccatggagctacctattgccagggagtagaacagattatgggaattgaaattcccagacgtgctgagtttcttcgggcaatatggtcagaatactcccgtatgcacagtcatctcctctggcttggatgttttgcagacggcatagggtatgaaaacctctttatgaactgctggaaagtcagggagaagattcttgatgtgttggagcggacaaccggaggtcgggtcatccagggagtgaaccgtgtcggtggtgtcagcagggatatggatgcagcagagctgaagcggattgagtgtgaaatcccaggtttacgggatgactttacagaactgacccgtatctttgatgaagatctgacggttcagacgaggaccaaaggaattggtatactcccgaaggataaggcatgggatcttggggcagttggtccggttatcaggggcagtggatatgccgttgatgcacgatccaccggttatggtgcctatgatgaacttgatttcaaaccggttgtcagaaatgaggctgactgtcatgcccgttgtctggtgagagcagaggaactcttcacatcgctggatctcatagagaacgctattgaccggatccctgccggtgatatcctggcaccagtcaaaggcaacccgtccggtgaatattatgcacgggcagagcagccacggggagaagttatccactatgtgaaagcgaacgggaagaaaaacctgctccgtcaccgggtcagaaccccaacgcttgccaatgttcctgctcttgtccatatgctggccggatgtgaactagccgatgttccggttatcgtgctgacaattgatccctgtatcggctgtatggagcggtgattctcatgaaagtaggagttatggccctgaccgtcctcaaaaaccttgtcaaaggacctgcaaccatcagatatccataccagccggcaaagatgacgccggtaacccgtggtcaccttgttatcaatattgatgattgtatcttctgtggtctgtgtaagatgcattgtcctgctgatgccattgaagtcagcaaacctgaccggacctggaggttaaaccagtttcagtgtgttatctgtgggtgctgtgtgagttactgtccgaaagattgtttatccattgagcagacgtatcttccgccgacgacatcagcaacgattgtttctgtaaccgggcctgaacctgataagaaagaggggcagggagaaccagtatcaagttaatttttataattttttttgagaaattctgaactaataagccagataatatattcaattttctcccctgacaagtttaaaatcaggaaagagaatatatgagagagaacaattgaggactgccagatgaaaagatatcaatttacaaccctaatttgggaagaggagggagtctacgtttcaaaatgtgtggaaatcgaagttgcatcctgtggtgacaccccaaaggaagctcttgataacctccgtgaagcgattgatctctggctaaaaaatgctgagtttctcggaatcttaacagatgctctcccttcaataacctcatcagaaaaatttacctcggtgatagaggttgaagcagcgtgaagttaccataggtttcatcaaataccttaataaaaaaagtttaaaaaaattggttttcaagaagcaccatatcaaggtaaggggagtcatctcgccctgtacaaggagtctaacgggacaaaaatcctcataataattccaaaacgtgatcctattccgattggaacccttttgtcaattatgaagcaagcccggatggaaagagaagaattcgtggattttctgaatcagtgagagagatataatcaaataataacgaatagatggccggatatggtttcttaaaacagttgggatttaccgggactggatcttttttaaccaattttaatgtaattctcgaaacgctcaatttcgaaacttattatccattatagaccaaactgtatgtaatggggaaacttgaagatctagagccaggtgcaatagtcagaggcatcctcccctcatcactggttacggtaaccagtgtgaaatggtatgggaaggactcacttaaactcacctatgaagattcttcaggccgggcagataaccgtctcttatatcgggataatgaatcagagtttgaaattgagactgaagggagaccctggagttttctgggagactcggatctattccggatggctgcagaagccaggagaatacatcttgctcatctctttgatcccctccttgctattcatacctccctcgtcgaaccccttcctcaccagattaccgccgtatatgaggagatgatcacccgacaaccactcaggtttttactggcagatgatccaggtgctggaaagaccatcatggccggtcttctcatcaaggaattaattgccagaggtgatcttcaacgatgcctgatcgtttgtccaggaaatcttgtcgagcagtggcaggatgagatggatagaaagttcagcatcccgtttgagatcatgacaaatgacaattatgaggcagccagaaccggtaactggtttttagaaaaccctcttgccatctgtcgccttgacaaactctcccgaaatgaggatgttcaggaaaaattacgggttacagattgggatctggtcatctgtgatgaagcccataaaatgagtgccagctttttcgggggagaggccaggtttacaaaacgataccggcttggggaactactctccggagttacccggcattttctgctcatgacggcaactcctcacaatgggaaagaagaagactttcagctctttcttcgactccttgacggtgataggtttgaagggaagttcagggatggcgtccacctttcagatccctctgatctcatgaggagactgctgaaagaacaactcctcaaatttgatgggactcctctctttcctgaacgtcgggcatataccgcaaattacaccctttcaaccatcgaggctgagctataccgtcgtgttactgagtatgtcagggaggaattcaaccgtgctgatagcatagaaaacgagggacgaagagggacaattggatttgcccttactatccttcaacgtcgtctggcatcttcccctgaagctatctatcaatctcttcggagaaggcgtgaacgactccaggaccgtctccgggaggaaagacttctccagcgtggtgccgatcgcccggatatcagtcgatcaatccctgaaatgagtcgggatgatatcgatgaacttgaagatgcccctgacgaagaacttgaacagatagaagagcagttggtagaccgtgcatctgcagcccggacgattgaggaactgaagattgagatagaaactcttcaaactctcgaagaactggcactccgggtcaaacaatccggttctgataaaaaatgggaagaactctccgcaatattgcagggtgatcaggagatgttcgatgttcatggttcccggagaaaattgatcatttttactgaacatcgggatacgctgaattatctgactgaaaagatccgggcacttatcggaagggaagaagcagttgttgttattcatggaggtttggggagggaacagagaaagaatgctgaacaggcatttacccaggataaagaagtcctcatccttattgctacggacgctgccggggaaggtatcaaccttcaacgtgctcatctgatggtcaattatgatctcccctggaatccgaaccggcttgaacagcggtttggcaggattcaccgtattgggcagactgaggtctgtcatctctggaaccttgtagcggcagagaccagggagggtgaagtgtggaagcgactgctcgaaaaattgaatattgaacgggaagctctgggaggtcaggtctttgatgtgctggggagtctgacttttaatgatcaaccgcttcgtgatctgttgatcgaggctattcgatatggtgaccagccagagattcgtgcaaaactgaacaaggtcgtcgaagcagctcttgaccatgatcacctcaagaaactgatcgaggaacgagctcttgtctccaatgccatggatgtcagcatggttcagaagatacggcaagatatggaacgggcagaggcacggaaattacagccccactagagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacgatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcactatatcggctcatttttcctgactgcattccgttccctgggtggttctattcatgagcgggagagtgaccggtatgagatcccacatgtcccggtagtcatccgaaaccgggaccggatcatcgggactcgtgagtctattctgaaatcatacgaacgggtaacttttaataagaaactcatcagagctcagggaaaaccacttgcagagtttatctgtcctggtcatccgcttcttgaatcggtcattgatcttatcagtgaacgatatcaggatctcctgaaacaaggcgctatcttcattgatgaactggatacatcagaaaaaatccgtgcattggttatccttgaacacagtatctctgatgccagtattacccggaccggaaccagacggattatttcccgaaggatgcagtttgttgagatctctgaagaccaaacgattcattctgccggatatgctccatatctggattaccgaccaccaaaagaggatgagttgccggttattgaaagttttggagttcctgaatggattgcccggagtcttgaagaaacggcgagtgattatgctattcaacatctggttccggaacatctggcagaagtaaaacggcagcgggaaccattgattgataaaacgcttcaggaggttcataaccgcctcactcgggagatcacttactgggattaccgtgctgagcaattgaaggaacaggaacaggccggccgggtcaatgctaagattaattcagcaaaagccagggctagagccgatgaactgtctgcccgtctccatcgtcgtgaggacgaactgaatgaggaacggacccttaccccatctcctcctgttatgactgggggagcgatgattattccgattggactactctggaaatttgaggggaaaactcatactcctaatctgtttggctgtgataccaaacgggttgaactccttgcgatgaaagcagtaatggagtatgaaaaaggacttgggtttattccccgggatgtgagtgctgaaaaggtcggatatgatattgaatcggtaattccggggactgggaatctccggttcattgaggtaaaaggcagggtgaaaggggcaacaacggtaacggtaaccaggaatgagatcctgaccgctttgaataaaccagatgatttctatctggccttggttgaggttgagggggagcagacaacggttaggtatgttcagcatccgtttaaaaaagagccggattttgctgcgacaagtgtgaactatgatatcagtgaattaattcaatgaaaacctatgattatataggtaattctaacaaatatacctaatattaatggaagagcgatcattcatagtaaattgatgttggattatgttaaaagatgaatttgaacgaatttgggagcaattaacccaaaaacgtccgcatgtaaataatcgattagaacaagtacgtattcaaaatattcgtggcattgtggatatttcaattcgctttccatatccagttagtgtactcgctggaccaaatgcatgtgggaaaacaacagttcttcatgcattaggatgcctgtatataaataaattgggacgatcatttactcctgcaaaattatttcctgattttaagacaaaaaatccagatattcctcatgattctggtggaaataatcaaatttcatatctatattattctaataaggttccatcagagatgttatggaagagaaacgcggataaatggaataaaagttattttgggaggaagggcgttaatcagccggaaagaatagtttatcttcgcaatctttcacaactcagtagtcctgcagaaattattagccttcaaaaaatgggacaagaacaaattaactgtgatgaaattcctccccaactgattactctcgctcatcaaatcctgcctcatcattatgcccgtctttatttattatcccataaagccaaagatttgttatttgctgagcgggatgatgctgatcatccaagttactcagaatttcatatgtcagccggtgaaagagctattcttcgcctatcaagggatatatcaactcttcacgatgccctcatattaattgatgaaatcgaggcaggattacacccatatacacaacaagtgcttatgctagaattacagcgtcttgctcttcggcaggatctccagattattgttacatcacatagtccatttattttagagtctgtgccatctgaggggcgcattttcttagaaaggtctgataatggggtgaccgttaccccaccgtatcgcgactttgttcaaagggcattgtaccaccaatatttggacttattatctgttgtttgtgaggatgatataagtgaagaattggtgagaggggttgtcgaaattctttctccgaaattggatcttcgacagtcaataattcaggttggacgtgatacaggtaaggatgaatttaatcattatatccgtgcgttggctaaatttaacagattggatcaatttatctttgtcctagatggagattctagagactataaagatcaacttgagaagactgcaaaaactgaacgatgctccttaatgattttagtccttcctggtgagtattcacctgaacgctatattattacaaccttaaatcagtactcgagtgaatacgcagaacatttcggttgctcaagtcatgattttcggaagattgtatctgactttattcagttatatgaaaaaagtacaggaaaggaacgagatattgcaaaggagattctccattccatcagtttagagattaagactgatgaaggcagaatagccagaacggtcggtagagtagagactagtcgaataggatcagatatggaaattttttcaaggggactagaagaatttattcttctctggaggtcctaatcgtttgaatgcataggatcttcaaatccaatatatgagaatgtgcaggaattactcgaattattgtagacttaccttaaattgtactccatatcccaatatgacgttggtggatgctttaaataaatgatcagaaaatatttcaccatatctattttgaaacgtataaccaataaatgtttattcaaacaaatgaaaaacaaggcaatatagggatctcatgacagagagacaaaaaaagaaaaaaacattatcaatatcacaacggtattcctcatcagagccaccaaggacaatacttaccaatgaatcaactgcacaccctcataagttttcaataggcctgaaaaacatcggtccaattgaatcgggtgacattacaataaaaccctgtacaattattattggttcaaatcgttcaggaaaatcctatatagcaaaaataatttatgcaatgtactcccttcagaatgacctttattattcaacaggttcttttcaatattttcaaaataattatcttaaagatgaactcccaataccccaggaattatttaaattaattcaggaatgggatataaaatcagacttaattcttcctgattcaattctatcagaaatatctgattctcttttttctaatattacagaaaaactctttacaaatgcactaatcgatgtttttaacactcaattaaatgaattaatttcaaaacaacgcaatgagggtgaattcctatttaaaattcgaggagaaactctttccacgacattagataaggaagggcttcatttacacattaaaccagatattctcaagctaatacagtataaaattacgtatcaaaaaaacgatgataaaatagacataagttatcacaattttcattttgttcatccatattctctaataagagataatgatgggcttttaaaaattgctcgtgatatgacctattgcattgcagcaggaatactacaggattattatttttacaattcttttgatggtgtgtatttcccggcaggaagagcatctctcatggagatgaaaccttttgtcgcaatgcaattgttaagttcatctcgtgccagtgcaaaaccctctccaaagatgagttcagtcttctctgacttttttgcattacttgagaaggtattagcaacgaaagacatctcaaatgatcagtatgatgaacttatagggcatttaatcggaggaagatttgaaataaataaattatcggataatgagtttgagtaccaatattactctgaaaaaaatcctattccgtttcatcttctatcttcaggagttcaggaattggcacccattcttctctacattaaatatcgtatgcaacctggtgatctgatcatcatcgaagagccagaagcccacctacaccctgcaaatcagttactgatggcacaattgattacaaagatgattcgggagaaagtaacggttgttcttactactcatagtgattatctggttgaacaacttgctaattatcttaaaacgggattattatccccggatgaccgtaaaggtcttgtttcagatagtgatctctacattcatgatgatgagatcggcgtgtatgtcatggaaaaatccgaaaaagacgacctttatcatgccagggaattacccattgatccactgataggaattccttcagaagaatttgtccgtgtctctgaaatactatacaatgagacaattcagattgaacaggaattagaggcagaataaatatgggttccaggattcggaagttgcctcttgattgtcttaaagataagtctgaagatggttttttggaggaagagactaaaaggaagagatgttctgaaaagggaaccgggattagatttgaacagattgaggatgttctcataattaaatcagaaaaattacgaaatgaaaaaggaacttttctgaccgaaattgatggatataaggtctgtgatcacattgttttcatcaaaggggagctggaatttattcttcttattgaattatgtaaaggttcttcaaaaagccatgatgagataattcagcaattctctcatggaggtgaagaatcccttcgacttcttaaagaatgttcacatccccctgattcatgtatttttggttttttttatatttacacaaccgtgagaagtaaccagtttttcaagatactgaaaggaaaaagggtccgattcaggggcaaagattacccagtacgtcctatgcaagcaaggaagaatggttttttcgtagcaacacctgaaattcttgattctgaactcattcctcgaaaaaaacgctgattgtgatccaatgacacaacaaaccaccccaccctaccgaaaaaaactgatcgaagtcgccctccctctcgaagccatcaacaaagaatccgcccgtgaaaaaagtatccgccatggtcatccctcaaccctccacctatggtgggcaagacgaccacttgctgcctgtcgtgccgtgatattctcctccctggtcgatgatccttctgcctggcctgaactctttcccaccgaagaggaacaagagaaggaacgtgagcgactcttcaggatcatcgaagaactggtcatctgggagaactcgaataatcccggcgttctgctgaaggctcataccgagattgcccggtcactcgccaggggccggaatgagcctcttccagaaggagcagatgcgattagggcatacattgctgaacatgctcccccgctctatgatccgttctgtggtggcgggtcgatccccctcgaagcccagcggcttggtctgaaggcatatgcgagtgatctcaacccggtcgccgtgttaatcaccaaggccctcatcgagatcccgccaaagtttgctggtatgcccccggtcaatccggagtcccggaaaaataaaaaaatatcagggggatgggaaggagcaaaaggactggccgaggatgtcaggtattatgggcaatggatgcgggatgaggcagagaaacggattggacatttgtatccgaaagtcaaaattacggaggagatggcaaaagaccggcctgacctagtaccgtatgtgggacaggagttaacggtgattgcctggatctgggcaaggacagtgcaatcaccgaaccctgcagcggggggggcagaggttccattggttaggtcattttggttatctacaaaaaaagggaaagaagcatgggttgaaccaataattgatcgagagaaaaatgaatatcattttgaagtaagaaggagtgatcccacgataaatggacctttagaaggcattatgagtaggaaaggaggaagatgtctaatcaccgatgttccaatgccatatccttacatacgatcagaagcaaaggctggtcgaatgggaacccgtttaatggctatcgttgctgaaggaaatcgtggtagggtttatctttctccctgtgttgaacatagtgagatcggtgaacagattaaagcaatttggaaaccagagggggaaatccccaaaaaacaccgaaattttcaaccccctgtatatggtatggataattttggtgatctttttactaaacggcaattagtaatacttaattgcctttctgatctcattcccgaaatacatagtgaaatatctaaacgaattaaggatttaaaattagaatccagcgacgaaaattataatgattatgcagatgcagtcgcaacatatcttggctttgcaatagataaaggtgtgaattattggtctactctatctagttggcactcgggaagagacacagttaccagtacattttcgagacaagctttaccaatggtttgggattttactgaagccaatccctttagcaattcatcgggaaatatctcttcaggaattgatcaagccaaaaaaatgttagaaaatatatatgcaaataatccaggtgaagtatatcaaagagatgcatccagttcattattgaatatcaattcaacaataatttcaacagatcccccttattatgacaacatctgttatgctgatttgagtgattttttttatgtatggctacgtcgctctttaaatagtatatatccagatatattttctactctattaactcctaaaaatcaagaattaattgctagttcaaatcgccatgatggagatattcataaggctaaagttttttttgaaaatgggttaaaaaaggtttttctgcaaattaaaacaaattacaatactttgtttccatttacagtttactacgcgtttaaacaatctgaagttgataattctgatgacttaaattcccaaataatttcaacaggatgggaaactatgcttactagcctaagtgaagcaggtttcatgattattggcacttggcctatgagaacagaattaacgggaaatttgaaaaagcagttttcagcactcgcttcctccatcgttctcgtctgtcgtccccgtcctgacgatgccaagaccgtaacccgccgggaattcctctctgctctaaaaaaagaactccctaagtcccttcacaatctccaacagggactcattgctccggtcgatctcgcccaggctgctattggtcccggtatggccgtatttacccggtatgccaaggtaatggaatcagacggatctgccatgaccgtccggactgctctcggaatcatcaaccagatccttgacgaagttctggctgaacaggaaggagaattcgataccgatacccggtgggctgttgcctggtttgaacaacacggaatggaagaagggccatatggagaagcagaaaccttggcaactgctaagaatattgcggtccaggggcttgtcgatgcaggcattcttaccgcaaagggaggaaaggttcatcttatcaatcggtcagaatatccgaataattgggaccctaccactgacacccgtctcccagtctgggaagcgacccagcaccttatccggacgcttgaaaatcagggtgagcaaggggctgctgatcttttgaataagcttggagggacgatgggagatcaggcccgtgatcttgcataccggctctatgccatctgtgaacgaaaaaaatggtcctctgaagccctggcatacaatagtctgattatttcatggccggagatcagtaaattggctcagggaagtcttactgggacgactggacaacagacattgtaaatatcggttaaacagaaattgcatgctataacccgcattgaataatgaaaaaaggtcacacactgtgtgacgtattgatattatcacaaaataatctccaaggaacaattatagaacctgactcctataccaatcaacgattacaataagagggatcctgataatgaatgaaattccagagcaacctgatctacaggaggaaaagatgaaagagaaggttttaaccttcccggtgaaatatcgtggtatactcacaggttttaatggaagagaagaagaacgtctcatgcgaaatgaatgggactgaaaaacacgaacaaaaaggataagatgagaatgggaagatctgagaaacctccccagatagaaaaactggaggtgaaaaattaccgggtccttcgtcacctggaattatcaaaacttacccccttaaccatatttatcggaccgaatggaagcggtaaatctacaatatttgatgtatttgcgttcctgtctgaatgcttcacccaaccgggaggactacgaactgcatgggagaagaggggaaggtttaaacatctgcgttcacgagggagcaccgatccaatatccattgagataaagtaccgggaaaaaagtgactccccactcatcacctatcatcttgagatagatgaacgagaacgaggtccagttgtaacgagtgaatggctacaatggaagagaagttcatgggggagaccatttaaatttcttgatttttctgaagggcacggcaccgtcatcaccggtgagaacccggatgaatcagcagaacgacaggtcgaatctctcaattcaccggagacattagccgttgcaacactgggtctgttctcaaaacacccccgggtgagtgctcttcgggatttcatcaccagatggcatctctcatacctgactgcagataataccaggaccactcctgcagccggagggcaggaacacctctcatcaacgggcgataacctgccgaatgtgatacaatatctcatggagcggcatccctttgtatatgaagagattcgccagaccctgacatcccgcattccacggctcagccgtattgatgcagagataatgggagatacccggttaaaccttcagatatatgatgaaccatttaaagaaccaatccttgcacgctttgcatccgacgggactttgaaaatgcttgcatacctggttctcctcaatgacccggttccaggatcacttatcggaatcgaagaacctgaaaaccagcttcaccccctgctcctccctcaccttgcagaagaatttcataaagcaacaagcaggacgcaattactggtgacaacccactcacctgcccttatcaacgaagcaaaaccggaagaagtcttctcgatctaccgggatgaagatggatataccagggcagaacggctgtcagatatcgaagaactgaaaggctttctggaggaaaagatccctctcggagatctctggatggagaattttgtcccgaacagtgatcccattacctattccagataccaatgaagattgacattctggttgaagagccatccatgaaaggatttctggagccagttcttccaaagattatacttcctccggatacctggagtatccatgttttgtcttgctttaagactaaacttgaaaaacggcttcgaggatttactcatcaggacccaggaaaatacagaataatcatcataagtgaccttgatcgaaaggattgcagggagatgaaacaatggctcgaagaaatcgtccatcgggctggtcttcatacaaaaaccaacccagatatggatggttcctattcggtgataacaagacttgcaattcaggaactcgaatcatggatattaggagatttccgagcaatacatgcggtttatagtcgtgtcccggaaacacttggaacccatacgaaatataaaactcctgataatgtaggaaatacctgggaatcacttcatgctttgctgaaaaaaggtgggtactgtggtgacatctatccaaagattgaagtagcccgaaaggtagcttcacatatcgaccctcacatgaatcagtctcaaagttttcagatatttcttcagggactgaacacactcctctctccttcatccacatccacataatcaggagagaactttttctttttcaccctcactcaagaatcaaaaccgaaaaattctattatctttaattaagagttctattaaccggtctttatattctggtgcattgagatggcattatcaaattacgacagagtggggagggcaatggatcagctcaaaaccggacttatgcggtttgttgagcgggaaatgaaatctgcatatggtgaaacctggcaggagatggttacagatattcctccacgggatggctgggtggattactgggatgtccagaaattgctgcttgtcatgtgggatcaatgggcaaaggtcttctcacaaatattaggtcataccgagagaagccttgtttcagaactcagggagaccagaaaccagtgggcccaccagaaaccattctctacgaatgatactcttcgtgccctcgacagcaccgcccgccttctcaatgcaatatcagcatctgcagaacatgccgaagtggaaaagatgcgaatggacctccttcgactccagtttgaagagatgcgaaggaatgagatgcgaaaatcatcattccaaccaaccgaaggaaaaccaatggggggccttaaaccctggagggaagtcatcacccctcaccctgatgtagcctccgggcgatatcaacaggctgaatttgccgctgatctctggcaggtatacctgggagaaggatctgatgaatataaacacccgacagaattcttccgccggacattcctgactgaaggactcagacaacttctcgtgaaaggtctggagagacttgcgaataatggcggagatccagtagttgaattacagacgaactttggtggggggaaaacccactcaatgcttgcactctggcatatcttttccggaagtccggcatcagaccttccgggggttgaagaactcctcaaagatagagccgtaacaatacctcataatgtcagaagggtcgttcttgtgggtacaaagatatcgcccggtcagccggttacaaaacctgacggcactctagtccggaccctctggggagaaattgcatggcaacttggcggcaaagaaggctatgcaatggtcaaagaggatgatgaaaaggcgaccaaccctggagaccggcttcgtgaactttttaacaggtactctccctgtcttatccttatagatgaatgggttgcctatgccagacaactccatgaaggaaccaatcttccggctggaacttttgaaacacaattcacctttgcccaggccctttctgaatcagcaaaggccgcaaaaaacaccatgctcgtggtctcaataccggcatctgacaacgaaattggtggagaatgggggaaaaaggcacttgagcggttgaagaatgcaatcgggagggtagaatctccctggcgtccggcaagccaggatgagggatttgagatcgtcaggcgtcgtctgtttcagccacttacccatgagcaggcagtccaccgtgacgcagtagccagggcatttattgatttttacggaactcacactacggaatttccgattgaatgccgggaaggggagtatgagcgacggataaagatggcataccccattcatccagaactctttgaccggctctataacgactggtcaacgctggacaaattccagagaacccgtggtgtcttacggctcatggctgcagtcatccattccctgtgggagagacaggatgccaatctcctcattatgcctgcaacggtcccgattgatgattcaaatgttcagtttgaattgaccaggtaccttgaagaccagtgggtcccggtcattgagaaagatgttgacgggccacactctcttccgctcagtcttgaccgggataatccaaacttagggagattctctgcatgcaggagaatagcacgtaccatttatcttggttcagccccgactatccgggcatcaaatcgcggcatcgacgaaaaacgggtgaaacttggatgtgtccaaccgggagagacggtcccgacatttggtgatgccctccgaagactgactgataaggcaacctatctctatgttgatggaacccggtactggtattccacacaaccctctgtaaccagaacggctgaggaacgggctgaaagaaaatctcctgaagatgtatgggatgagattcaacagagactgaacaaacacgcgagaacacgaggggatttttcaaaagttcatgtctgtacgcggtcacaagatatcccggatgaacgggatgccagactcatagtactgcatcctaaatttgcacacaccggacgagaagattatagccctgcgattgaggaagcaacaaatattttgtcttttcggggttcaagtcctcgaacgtaccggaatactctggtgtttttagctcctgattcgaccagactctctgacctggaaagtgcggtgagatattatctagcctggagtagcattctccatgatcaggaagaattaaacctagataacttccagaaacggcaggcagagacgaagaagaaatcaatggatgataccattgaggcgagaattcctgagacatatcaatggctcatagttccaactcagccagatgtaaggggagagattgaatgggaaactcttcgcctgcaagggcaggatgaactaaccatccgggcttcaaagaagctgaaaactgatgagatgctgcttaccgaaatgggaggagtccgactacgactggagttagatagggtaccattatggagaggagatcatgtctcaatcaaacaacttatcgaggatttcgcaacatacctctatcttccacgattaagagatgaacaggtcctcatatcagcgattaaaaattctctgaacactatatcagttaatcctgatacttttgtgtatgctgccggttttgacgctgagaaaaatgagtatctgggactccagttcatggcaaatggggcggttttctctgatagtatgagcctgttagtaaaaccgggaattgcacaagcacagttagaaagaaaggaaaaattaatcattgatgactcaggaaacctaaagccaataaataatcctactcccgaaactgatgggggaggcattccaactagaattaatcccccatctcctgttgtaaaaccaaaggtatatcatcggttccatgggcatgtcacggttgatgcagaacgggcaatacgggactttggtaccataaaagaagaaattatcaatcaatttacaagcaaaattaaaacaaaagttaagattacaatttatattgatgcggatatagagaatggtgcagacgaaaaactgattcgggatgtatccgaaaattgtaaaatattacattttgatgcctgtgagtttgaagattaactttcagtttcttatggatatatccaatataactaggaatacttagtgaaaaactatttcagttgaacaaaaaatctttgtttaatcactcctttaccctgatctcactgctgcctgagccattttctttttcactttcttccgttcaatcaatttcttcacttttttcaatctgaacagatcttcccgttcccgctcctcgatactgaaccggatatacttagcctgctctttcagttccggaataataatctgatccagggcattcacccgtctgcggttcatctggatctcattcccgatccggcggagagtcgtctcggtctcggcaagccgaattatcatatccatctcggcctcgaacttttcagccgcttcatttatccggctgctggtcccgataagcccgtatccccgctgcatgacgttcagggcaacactcttcttctggataaccggaaccgggactcccatgatattcttcccggatatatcaaccatgatctgccgcttggttgcataggaggcagatttaaccgcaatcggatcatctaccgcttcagctacgaggagggcaagatcggcctcgatggcaagttgttcaagcccttcccgtgattctgaaaaattgaccatgatcttaaaaaattcctggatgagagcctccatcttctctttgaggaggtcacggccctgctctgccagcacgatctgggaccgttttttcatcagctccatccgggtcgggtgcacctgctccatggcctaccctccggatatgataagagtccggtatttatcgatatactcttccttaatccgcttcagctcctcatctggcagcaggctgaagagttcccaggcgacctgcaacgttgtctcaatgcttcgctcaacgttcccctgtgatataaaccgtttctcaaagtgatcagcaaacttgagataattccggtcaagctccgagagtgcttcttctccgacaatggcaacgagtcttcgaaggtcccgcccataggcatatgaagcatatagctgatctgccacattccgatgatcctcacgggtcttacctggcccgattcccaggttcatgagccgcgaaagacaggggagagcatcaatgggcggattaatccctttcctgaacagatcacgggagagtacaatctgcccctcagtgatgtacccggtcagatcaggcaccggatgggtgatatcatcatccggcatcgtcaggatcgggatctgggtgatcgaaccggtacagcccttgatacgaccggcccgctcgtaaatggttgcaaggtcggtgtacatataccccggatacccgcgacgaccaggaatctcctcccgtgctgttgagatctcacgaagagcatcgcaataatttgtcatatcggtcaggatgaccagtacatgcagattgtgtgtatacgccaggaactcagcagcagtcagagcacaccggggcgttgcaatccgttcaatcgtcggatcatcggccaggtttaagaagaagacgacccgttcaagggctccgctctcttcaaactccttcatgaagaatgacgcttccttgtaggtgatacccatcgctgcaaagaccacggcaaagttctcaccctcaccaagaacctttgcctgttttgcaatctgggcagccagctgatttgccggaagtcctgcacctgagaagataggaagtttctgtcccctgacaagagtgtttaatgcatcaattgccgatataccggtctggataaactcggcaggtttgtcacgggagtagggattgatcggcataccggcgatatcgagccgtgcctccggaatgatttccggaccaccatcccgtggccgtccgaccccgtccagtacccgaccaagcatatcataggagacatcaagaaggggtgactggccggtaaacctgaccgtagtcacatggctatctataccccgtgtcccctcaaagacctggacaactgcaatatcctctgaaatatcaagaatctggccggtccgtgcctcaccatccggaagaatgatctgtgctgtctctccaaacgagatctccttgggccgttcaacaaagatcaggggacctgatacataattgaccgtctggtactcaaccgtaatcaggctgccgtgctgcatgtctgcacctccaggttttcagtctgttcccagacaatatcactcagtcgtttcaaccggtccagatccctctgctctttcatccgtgctatctctgaccgtgccgggatggagaggagctgacgaagcgggacattccgtctcatggctgcacggattgcatcataataccagataatgatcttcagcatccagtactgtttttcaagcggacagaatgaatcatcatcactgtatgcactctgctgcaggaaatcttctcggatgatctttgcaatctcaagaacgaccttctccttgtcaggaagggcatcaggcccgacaagctgcacgatctcctgcagttctacttccttttgcagaatatacatcgcccgtcccctgaactggtaccagtctctggcgaccttctccgaaaaccagtcctcgacatcctccaaatacagggaataactccggatccaatttaccgacgggtaatgccggcggtatgcaagatttgcatcaagtgcccagaatgttccggcaatacgaagagtattctgtgtaatcggctctgagaagtccccgcctggtggtgataccgccccgatgatcgtcaccgacccggtcttctcctccgaaccggcacagatgacacgcccggcccgttcataaaaggcagcaagacgggttgcaagataggcaggatacccttcttcccctggcatctcctcaagccgtcctgacacttcacgaagtgcttcaccccaccgggacgttgaatcggctagaagtgcaacatccatgcccatgtcccggtaatattcagcgatagtaatcccggtataaatggatgcttcacgggcagcgaccggcatatttgaggtgtttgctatcatgatcgtccgctcaatcaggggatagccggtcctcgggtcggtcagttctggaaactcagtcagcacatcagtcatctcgttgccccgttcaccgcacccgatgtacacaaccacctgggtatctgcccatttcgcaagagtctgctcagacaccgtctttccggttccaaatccgcccggaatcatggcagtcccaccctttaccagggggaacatggtatcaaatacccgctgaccggtgagcaggggaacctccggatccagtcgtttgacaaagggcctccctttcctgaccggccaccgctgaagcatggttatctcggtcccgtctgcaagggtacatactacatcggttacggtgaactctccagaagcgatcgtttttatctcgcctgatacgccgggtgggaccatgatcgaatggaccagatgaaactcctggaccgttccaagaacatcaccggtctggaccatttcaccagctttcttcaccggattaaatgcccatctcttctcccggtctaggccggggaccatgatccccctgctgatatagttcccgcttttcgcatacagggcaggaagcggccgctgtaccccgtcataaatagatgccagcagacccggacccagctcgacggagagcggaacaccggtattctccaccggttcgtggatcataagaccggtggtatcctcatagacctggatgactgcctcatcaccttcaaggcggataatctcaccgggaagagcagccctacccacccataccacatcatacatccgcgatccggtcatattcctggcagtaatcaccggccctgaaatcctggctattgttccggtaatcatattagctcctcattaccacattgtatccaattgctctccggagcagccgttccacatatccgctcacttcatcgccttttcgtggtgcaggaatcgggatgatgaccgggtgataacaccgctcaacctgttcatacagactcttgtcaagattggccaggtaatcctccctgatggcaattattccggtctcctcttcgtgaaggagagatgaaagaactctggatgcttcaaaggaatcttccacctcaaggacatcagatccggcaagacgaaacccggttgctgattccggatcagtgatgacgacgactttatacatacaccatctcagcctccatatcttcaggggggatcagggcatttttacaccgggcgatgatacgcaggttcattatctcggtgtattttgcccacagatacccgataaccaccgtcaccgacagaggatccccccggtataacctgactgcatgtctgatgagatattcatcaagaagatgctggtacgtggatattttaactgtatcgccttcggtgcttcgaagatcagaaagaaaccggtacggagtctcttcaagatattcaatgagcgatgctatggagccaagatttaatagcattttgagcttctttcggttgaagacctttccaccatccagaagcattggctgagcatcttcaggatccacatgatcccgaaacatcatcaggagtgatttaatattgataagatcgatttcagttccgataatctcacggatcttacgctcttcaacagatttgccaccgacaagagaaagagcccgctcataatagaaccggtccagggcattttccagtatgaagagatctccctgagcattataatcaggaaatgcctgggtgaggggtatggcataggggacttcccaggttgccagaagatcaatgacgcttttgacatccggctgttttaagagttcagataggagtgattcatcaaattctccagctggaaccagattctcccggatctgcatggttggcactttaatcctctttccacgcagaatggtttttaaattgtgaatatcccatcgggaagaaaagatgaggatataccgctctcctttctctccctgaagaaattccgagatcttctgaatcgttctgataagattcagccggagagcttcctctatcccgctcagcccggattttccgacaagggcacgctcgagatcctcatgatatgaagtctcttccagggcagttatcagggaactgatgtcaggctttaaaatcaggttgcttaaactttttttatcaagcaaccgggagtacataccccgaatcctggcattgacatacccgctatccatcaggccctccaagaatcaggttgataatctcaagggtagacgtatccctgatccgttccattctgctttccagggtgttatatgcacgaatcctgccatctgcagatgttccggataatccaccaattgtcgtgatatcctgcataatatcacaaactataccggtttttttgagtacatcactgcaaattttcgaatctgccggatcaatatgaagaatgatttcttctccagcaagggcggaaataacctcacgagtcagccgctcatacaaagcaggatatgatggatcagacctgattccggagatcttctctttggaacgggaaaacgcatcatcaatgagtttttgtctgactgcactgatccttttcttcacttcctgtttcgcaaggaatttctggcggttattctccagaatcaggtcccgtttcgctttctccaggtattgagcatggatggcagatgattctgtctctgcttcccgaagaattgcctccacttctcgttcagcattccggagaacttcctgttttttctcctcggctgctgattctatggacttgataaggtcttcgtatgccattcttcgctcaccttctgcatcacctgggtagcagctctcttcactcaaccataatgatgatcattgccgctacgacaaaaccaagaataaccagtgtttccggaattgcttcaagaacaatcaccgtaccggccgattcaggtctttcggccacggttccggctccggcagcaccaatctttgactgagcgattcctgtggcaattgcgcctcctgcaaaggcgattgctgcgccaatggggacttcccatcctgtcatgataacctccatcgtttaccttatcctgtgcagatttatatattgtggtttgtctgtcaaaagaaagagaatggaaaaaaagaatcagagtctctcttttccaaatggcttatacggaacgcctccgccttcataaaacttggagaaaaattccacgacatgcaatctcagtgagtgaattgacggactgaacatggcgaggaaaatattgagtgtatgaaggagaatagcgacaataattcccagaacaaggatacccagctcatgcgaaagacggttcgccactaaagccagaataactgatgcaagacctattgccatcagacgggcataagacatgatatttccaatagtccccatcacttctatgactcccctgcttcctccgccatagatgagacagccaatcgaagccagcatcagcgcgattacggcaaatgttaccgacccaggtacatgaccggcatatgcaccaagtaagagaagaattccagataacagtccgagcatcccggctttttcgatgatatgcctggttttatggtgtcggtacgcattcagaatccctagggacaaacccaggaacacatgaaataccccgataccaatggtcagtatcagaagagggatgatggcttctatccgattccaggtgatcccgaatagcgtgatgggatgaatccagcccatgtgttccccaagatcgccaaaaaactctccatagaaatatccgaaaatcatcgtcgggatagatgagatcatcaggatactcatgagctgacagatccagggaatctccctgaatttataccggaccgccaggctgaaacacaggattaccagtccatacccgatatctcccacgatgagcccgaagaagagggggaagaagattgctatcagaggagtggggtctatctcccggtacataggcggtgtgaccaggttcatgaagaactcgaagggttttgcccagaatgggttatcgaagaagaccggagcatcatcataccgtgatggatcatcggggagttcatgaacgacaaccgactctccaaaactctccacgagggccttttttgttgccggtagaaatttcttcggtatccatccctttaccacaaaagtgtactcagtctgaccaaagtgtgaatatgcggatgtctcttcaagaaaatcggtgagcaaaattttcagggtgacgagatctgcataccacctggtcgaaatatcacgaatttttgcctctatttcagtaatttctgtacggattgcatccttgtctgcctgtatgagagtcagggcgtcatccagaggcatattcgtatactcctggggtatccggacttcattcacatttttggaatagagaaaatcatgaactttattggcatattttttactgaagaccgtaatgactgcaatgtttttctcatcaagatcagcactgataaactcaaactggttttttgtgatttcggagagaaacgggtgaataatatcgagaaccgattcaaattccttctgaataatcaggatcgtgacttcaaatccctcaagagtagggagttgctgctcaaggggagagatcttccgtatgatcttctcatatctaagcagggtcgtataccggacatcaaggtccccctttctgttttcaagtgacctgagtttctcctcgagtgaatcacagattgttgttgcagtaactacaagatctttaaaggggagacttgcgtatttatcaataaaagggcttttgttatgcttttttgagtcaaccggagtaaggatctggatctgtcccctgattctgatgagaagagaggataactcttcagtatgaaacgtatcaagaggacgtaccaccatgccatcagggatatcagtctttgcatcttcaagatgaatggaacctgcctggtacagtacatcaataatacgctgatagtcttttttcggacctaccaccaggattctcatcatcttttgcagcatgttatcccaggatcatctcgattattctgttcaccgcattatctacttttttctctcctgtcttcagaattttatctgcttcagcttctcccgctgcaagaatcgaactgatctgtacagcaagttcatcaagcccgctctgcatgtactgtgatgcctccagagctcctttttgttctgcatcctcccgcatactccgtgccctgacccgtgcatcatgaatccgggtttcagcctctttacaggcaatatcacattgacctttcagctctgcttcttttcgtgatatctgatccagcaatgagtgttcagtctccatactcttcccctttcccataaagccaggctgaaacccggcagtttaagaatcaggaatgcccgtatatgtcacaaataccaatattaaagaccgtatttgctcttcattctccgggtcatcccatagctgtcggtatcttcaagatgctttttacagggcggacggctagcggcttcgagtattcgatcctcgcaccgtttcattgcaatctgcttgagctcgaggatctttttcatatctggtacagccatacctatcaccccgtgtcatgtgagatagtgaccttttactatcacataatatttaagagtagtactccatgtatccatcagtgaataacaacatttctatcacctatcgataccaggcctttgtatggttttcaaatctctcccggaacagataatatatccaattcgcaatagtatatcaggaaaatgtcatcttcatctaaaccaaaagcatcttcaccggatcaaaatactccagaagaaccgctctcctttgaaaaagtctggctcatgttccaggagacagataagaaattccaggatacagatagaaaatttaaggagactgaccagaagtttaaggaaactgataaaaaactaaacaaactggaacgtttattcgtatcccaatggggaacactcgtagaatccctggttgaaggagatataatttcgattctcaatcagcgtgggatagaagtaactgacaccattaaacgcagatccgggcggcgtgacggtgttgattacgagtttgatatcatcgcgatcaacggaactgaaatagtaatcgtggaagtaaaaaccaccctccgacccgaagatatcagagattttttgaataaactaaaatatgcgaagacctggatgcccgaatattctgacaagcgggtgtacggtgcggttgcatttatatcagaagacgccggtactgcagcaatggctgagaagaatgggctgttcgtgatccgtgcaacgggtgacagtgccagcatagtaaatacagataccttcattccaaaggtctggtaggcacccattcagtgtgaggttaaacatatgttcagacgaattctgtttccaactgatttttcagattatgcacggcgtgtcatggactgcatcgcagatctccccggcgttgaggaggttgtgctggttcatatcgtaggtacagataaaccggcttctttgagaggagatatcacatcaactgcaaagaaccggatagagactgaagcatcccttttaaaaagtctcggtattccatccatcaaatctgaagttcttgtttcagaatctatcgcctcaggaattgatgatgcagcgacacgaaataactcgaccatcattgtcatgggtgccaggggaaaaagcatcatcaaaggtctgcatctggggagtgttacccaccggatcctccatgactcaaagaagaatctcctgatcatgagggggcagataattgaaaccctatctggagagaagtttcagaagtactgccccctgatcttttcacgggtcctggttccggttgatcttacccctgaatcatggacagcggtcgaacaactggcgaagattcctgatgttggagagatcattgttgcctttgtgatctcacggggtgagactgaacgggaacttgaacgtatcagaatccaggcagaacaggacattcaggagagatgtaaacagattcaaactgccggagcagagatcaggcatcgtatccttgaaggcgatcttgtcagccggatactggattatgcacaggaggcggatgtctcccttatcagtaccgtgccaacagagaaaggatttttcgccgagatgctccatggaagtttttcatgtgaactggcacggctggcaacaaaaccggttcttgtcatcagaagatcataacagattggaagtctgatctcctcccctctccttccgctccatgttctgcttcatccgctttcttctgaagaggtcctcccgctccctttcctcaagcctgaactcaatataccgcatggtccgcaccagccggggaatgacaagatgctcaagggcattcactcgtcttctcgttttgttcatctcaagcgagattcgatccacccttccttcaagtgacgcataggtgataagggactctaaaaccgattcataccggagagctgcctcatcaacctgcccggacgtacctgccatgctatatccccgctgggtcatgaaataccccgtcacgtcaggcatagagataacaggaacatggacacccataacctgggaagcggtgaccgtaggctccgggatctttccacaggctgcagccagttcttcaagtctgacccatccggtcatgatccctgccagttcaagtgcattataggcagcctgcagttgatcctggattgaaacagccatggtttccagctcttttgtgaggcgtgcatgctcaatgacgagggcatccagcttctcctgcaggatatccctgcctttgcgggcgatctgctcacgtcgtgagagccgtatcaattccagccgcgttggccttaccccggcaattacggccctttgcattccagaatctcctcgccatgatagtacattttgataaactcagtgctgatccgcttcagctcagcctttggaagaattgacaaaaggtcccacgcaagggtgagcgtgtcatcaaaagaacgatcctcgtatgatgcctgcctgatgaaatcattctcaaaccggtcacaaaaccggatatagagtttatcaagcggcgtcagcccctcttctcccataactgctacgagacttttcagcctgatacccctggcatatgcagagtagagctggtttttcacctcagcatgatcggccctcgtcctgcctgggcctatccctccctgcataagacgggagagacaggggaggacatcaacaggcgggtagattcctttccggtgaagatcccgtgagagaacaatctggccttcggtgatatagccggtcaggtcagggaccgggtgggtgatatcatcgtcaggcattgtcaggatgggaatctgggtaatagaaccttccctcccacgaatacggccggcacgctcatagagagatgcaagatcggtataaatataccctggatacccacgtctgcccggaacctcctccctcgctgctgcaatctcacgaagtgcttcacaataattggtgagatccgtaagcaccacaaggacatgcatacccttgtcaaaagccaggtattctgcggtggtaagggccagccgtggagttataatccgttcaatggccgggtcatctgccagattgaggaagagaaccgtccgttccagtgctccgctctcctcaaactccctgatgaaaaaggccgactcttcataggtaatacccatcgcagcaaagacaaccgcaaacttctctgcctgaccggtcacttttgcctgtcgtgcaatctgtgaagccagcaggttatggggaagtcctgctccggaaaatatgggaagtttctgaccccggaccagagtgttcataccatctatggatgaaatcccggtctgaatggagtcgcggggatgttcacgggcagacggatttatcggagatccgtagatatcacggatacattcaggaatgaccgggccgccaccatctattggccgggcactcccatcaaatgtcctcccaagcatgtctgatgacagggatatcttcatcggctctcccctgaacctgacttgtgtcttctcggtatccagatccctcgtcccccggaatacctgcaccatggccctggtcgttgttgtctcaagcacctggccgattcggacctcaccgccggggagcgtgatctctgctatctcaccatacccgatcccctcgacaccgtcaagaaccatgagcggaccgaccacctttgacactccggtataggtccgaaatctcagatcggtcataaaacctccttcagatcccgtatcgcgtccgtatcacgggctatactttcaaagagcggatcctcctcttcaggggatgcagtgcccattcttgcaaatgattcaatgacaggaagaccacggagccgtgagacagaaatcccggtttcaagagctcgttctgcctgggagaagaacgtgaagatggcttttaacatacgatattgtttcttcgggccggtaaatgtatcaaattcatcaaaggcatactgcatgaggtaactctcccgaaggatctcggcctttaagaggagcagacggtcagattcaggaagtgtttccggaccgaccaggcggatgatctcctccagctcattctcccgttgtaatatctccatcatctcctgcttcatcctgataaactccgggccgatatgctcctcccaccatatcccggcgataggactgtacaaagagtaagacatgagccagttgatcgcaggaaagtgccgctgatacgcaagatccgcatcaagtgcccagaataccttgacaatacgaagcgtgttctgagtgaccggttctgaaaaatctccacccggcggggagaccgctccgattaccgagatggatccctcatgatcccctgacccaagcagagacaccctgccggcacgctcataaaagtcagcaagccgggaactcaggtatgcaggatagccttcttctcccggcatctcttcaagccttccggatatttcacgcatcgcctctgcccaccgtgatgtcgagtcagccataagggcaacatggtaccccatgtcacggtaatattcagcaatggtaatcccggtgtataccgatgcttcacgggctgctaccggcatgttacttgtatttgcgataagaaccatccggctgctcagggcatgaccagtccggggatccttgagggtcgggaactgttcaagaacatctgccatctcattaccccgttccccgcacccgatatagatgataatgtctgcattgacccattttgccagctgctgctgaacgaccgtttttcccgaaccaaagggaccgggaatagcagcagttcccccgcgggcaagaggaaagagggtgtcgatgatccgctgcccggtcaacagcggctccacagggtccagacgttcacgaaccggcctcgggtctcgcaccggccaacgctgaatcatggtgagttctttcttctcctctccggtatcaaggatgacaatggtatcagtaatgacgtattctccctgttctgcaatgaaatgtatagtaccagacaggccgggcgggatgagaatataatgattgaccgataccgactcacggacgcagccgatccggtcaccttcccgcaccatgtcaccagactttgcaagaggatagaaccggtatttttttgtccggtccagagccggagcagaggaaccccgttcgatcatatcaccggtattcttcaggatctcttcaaggggccgctggattccgtcgtacatggtgccgataagtcccggacccagttcaaccgacagcggaagataggttctgactaccggctcaccaggggtaagaccgatcgtctcctcatagacctggatggtggcacggtccccttcaagaatgatgatttcaccgattaatccgtcatttcctaccctcaccgattcatacatcctgctgccggccattccttctgcttcaaccaccggaccggttacccggataattacaccgtttttctcacccatggtatctgtctcgttgtgttttttccattgtttttccgaccatcagatcttacccggtgcagaacggtccgggttctggcacatccggtattaccgagataaccggaatcagatctgatgaactctttatgtcatgtattctgtccggaatcatggaggcaacggttctggtcaccagaatgattccaatatctgaatccttcaggcatgcatccagatgagcccgtgacgcttctgcatcctcacaaacatatcctctatgcacaccgccaagaagaaatcccatcaccatacgccgggatgcaagcagggctactttcatgtctcctccgggacggtgatgagcatcggggtgattttgtcagcagaaaacccatcatacaaccctgataaaatgatgcggatattgcgtaattcaaattcttttgccaccaagtaccagagcagcggacctccgatatggtaataggtaagccccagcctggatatggtatcgagaaggtactgatcaagagccatatccatccggagcatcgtatccgtagagggataggttctaagcacgggggagaggacgggatcatatccggtccctgagagttgccggagaagatccggaacactcatcatctcattcatctgaaccagcctccacatgggaagttcctgaccgccgtcaaccagacagggcgggattgcatcaggattccacccggagtgtttaaccctgatgagagcccggatattctggatatcaatcagaactgctataaaatcacggtacggggaggccagatatgtctggaccatcgacatctggcttttcagttctgaaaaacccatacagtcaagggcatgatccaggtaaaatacggacttctctttctcgtaaagagctagagatgaaaggagaggttcaccgtacctggtctcctgcaacaaacgaacgccttcactcatggaccgaacgttcccaagctttgctgcaagatccggtgagcatccttccggccagagtcccggagttgctgcaatcgcccctgcccggcccatgtggatcagccggatgatccgtttgacttttgcaatctcctgaaagaagagaacggcatcaaaaaagagccatgcatcccggggagcctgcgaacggagcaatgttacctcctcataccatgcaaggagcagttcttcttctgcctgatcaggtgtgcattctatcggtacgtcgatcagataaccataactcttcaacctgctcatacagtcctgaaccgaaccactctgcatgagttcccgaagctgttcaggttcaatgaaaggaactcctttcgccttcagccgtgctactatcggcgtatacgatgttatcgacaacagaaccggaaaatatccggcggtactgagaagagtcagaaagagcagaaccaggatgacgataaaaactgctcctgacaggtgggtaaaatacggggagcctgcatccagaagggtgttcaaatcagggatatccatcaacgttcaccatgaaagaggatacgtgatgctgcgacgatcatctcacgttccaggcgtacaaacctgacctctacagtattgtcaatcaccacccggtcagagatccgctcacagatgaccccgccactggtaataatcggctcttcagagagaatgagcgagaatccttcctggtttatcctggagatactatctgctgcaagcctccgatcatccggatgaacttttacagcaatatcagacgggccaaggttttttgcagattcggtaatcatggcctctaaaaatgaaggatattcaggtcttgtgcgtatcgtcttcagatacgaagacacctcatcaaaacactgcctgagcatctcctccctgacctctctgacctttcgtttcgcttctatcctggtcctcgactcctgactagcgataagctgtctgatctcacgctggccctctgctatccggtgattataggcattttctgctttttgttcggcctgggctctgattgcacccacatcacaggcttcttcggccctgattgtccggatttctgcctcagcttcctcccgtatccggttgataatggtttcaacagacatatgccgaccgtttatccgctaaagaggccgaggccaaagaggatcagaatggcaaccagcagaccaaagatggcaaacgtctctgacattgcagcgaacacaagcgatctcccaatcgcacccgggtttcgtgccgttgcagcaatcccgcttgaacaggtaatcccctgaccgatggctgaaaaaccggccaggccgaccgcaagacctgcccctacaagcccgattgcaaccggcatctcaacagagaagtctgatgataatatcccggtaagggcaagcatgagaacggcgataagaagcccataaattgcctgggtctcacagactgcagaaaatacaacacctttcccaaacatctctggtttttcagcggtattagcaacacctgatgatgcagcgatgccctgaccaattgctgaaaaaccggccagaccgacggcaagacctgctgcaaccgccacaagtcctgcaggagtagggatgtcagcggcagtcccgcccagaaaaccacccgcctgaaggataagaattgcaataagaaggccatatatcgcctgggtctggggaattgcagtaaacacgagagccataccaaatttttcagaccgttctgatatcacccctgacgctgctgaacccacaatacccactccgataccagacccaatagcagaacatcccactgctattccggccccgatagccattaaaaccgctccggtccctattgtcatattacctcctctcgtgtaccgcttgtatacacacggtgctcatgaaacggtacaaactcttttccgccaccggaatagaattttccaaagaattcaatataatgcagtcgcagggcatggattacacttccaagagtctggatggccaggttaaagagctggccggcaatacagaagagtattgcaggtattatcatcaacggatgaacagatgcaatcatttcagacagtatgttaattgtcatggcaattcctccggttgcaagagcaagagccaggattctgacataagaaagccagtctcccaaaaaaccggtaagactgaaaaatcccatcggaccattccggaaaaacagaaccagcagaccaatcaccgtgccaagaattgcgaaatgcgtaaccaggggagagaaggtcatccatccaaagaaatcgatcagcagaaccaccgctgccggttgaataacgaaccagataccatggtccataatggctgtccggtacatccggtcacgaacattctgccacaatccaaggaaaattcccagattgatgtgaatagtgccgataatcagtgctatctggaacagtagtatcggctgattcaatggctcgataagaacaaacggcggcgttacattgaaaaaccgggggagaagatccccaaaccagcctccctgcagtgtcccaagaaggatatcagcaacaccacaccagatgagaatataactcatgtcacgaaatgccacatcatgtctgcccggtccccggtagagcagccacccaacaagggctatgatgataccgtatccggcatcacccagcatcagtccaaaaaagagcaggtatgcaggggcaaaaaagggcgttggatcaatctcattataccggggcctcgagaatgtggtggtgaggatctcaaatggtgcaagccatcccgggttatcataccggaccggaacatcatcctcaggatctgcaggttttgagaagaggaaaaactcatcacccgtgacttttctaaggacgtcgtgcaggcgagcctgatctttttcccgaatccacccatgcaggtatattacatccctgcttgagccaaagttccgggatacctcataacggtcacgccagatcgaaagttcttcccgtattacccgaagaggggtgagatgggactcagccatggagatgagatgagcagtcaggctctcttcctctctcatatactcttccagccggttctgttcggtacgaatcatctcacctggcataccggtatatgaatcaggaagcgtgatacggaagaaccatgcatgatgagccagttcttcaagacgcggtctcattgccagggtcccaatgcacaaaacgattatttcctgcccgttttgtatcgtgtgatgatagatctcatcagttcctgattctctgaaccatgcctcaagaagagggagagattcctggagaatccaccctgctaccagaaatgtatacggagcaggtgccaggtaggagagcgaacaacctgggacagcaagccggtttaagttctctatcctttcccgtgttacctgctgcaactcacggttttgttttaaagcctcatatgttgtaagaaccggttcggcctgatcgagcatctcatgtgcagcctgaaagacatctccaggtgtatcatatctgaccgggagcggctgagagtctttgggaaagagcagcgataaaaccccctccggtctgacctcgtagggctcaaggatctccaaaatcctgtcatatctgaactgaagcgaaataatcctctcaatatctccgcgggggatctcaaatgatgtctgggggatctcagtgcccgttccctttttcagatctaggacttcaagctcaccctgctcatgtaacgcagaagtaacatccatgagccaccggttatgaataccgataacaacactgttcattctggccggataaaacatattactccccggttatgagtcggatcagggttgaaacagccgtatttttctgtctttctgcataggccctgatctgtccggcctcatgatgcacctcatccataagacgggcatgctcccgggcaacctggctttctgcccgctccctctcttcacgcaatcttttttcagcatctgaaagccgcatcagaacgagaccttccccctcccgtttcgcttcctcaattgccagcatccttctgtgtcgtgcggcttcgatcagagcagcagcctcttcttcactgcgttttatctgatctatttcagggattgccatttctatctttctagtctatcttcacctcatttatctgttgtcatccatgtaatcactggttgagaaatatcagaaataaaaagggaaaagaagatctgaacagacaggatcaactcatccacataccatgatacagggagagaaatagtaccagcagaaccatcggtatgacgagatgtatggtaaatgctgctccttccaggcaatacaatacatgtttagcaatttttacaggtttttgaaactgcatgtacagttatatttacaaaatggaatacatcctttcctctgtcgcctcaccgttccacaagggtatacgatcgtgacccaaggccgatcttttcagcatactcaagaatatatcctccatcgacatagtcccacacaccggtaaacttgttctcacctggttcatgatgacaatgaagtgaggaagaggggagtccccgttccttattaataaggtcaagcgctgcggcatcaattgcgaccggatcagttgatgccagaaatccgatgtcaggcactatcggtgcatcactccagggaacacagtcacaatcaggggtgatattcatcaggaaacttatatagaggaccttatttttaagggtagaaacggctcccagggcatattctgccatccgctctaggaaccgtgggacatcccgctcccagtggaataatatcgcctgttccggacagacctgaagacaggcagaacacccgtagcagacagatttatcaacggttgctttttttcccatatgaatggcatcaaaagggcattgcgtcacacaatacccgcacccgacacagcgggactcgttgatctccgcctgcatcccctgatgctgatcacgctttccgattggtggtgcacatcccatggccacattttttatggcacccccaaatccggcaagagcatggcccttaacatgggagaggacaaccatggcatctgaatcactaatatcctgcgcaatctttacggttttgaaatgtttcccgtttattgcaacctcacggtaattgttccctttcagcccgtctgcgataatgaccggacagtcaacaacagcataggcaaacccgtgacgaatcgctgtagacagatgatctgccgcattatgccgggaaccgatgtacatcgtattggtatcggtcagaaatggttttccagatatctcccggatactatccacaatagacctgacaaaaaccggctttatgaacgtatcattcccaagctcaccaaaatggagcttaactgcagtcaggtctccttcggttataatatcagaaaggcctgctgctgtgcaaaggtcccgtatcttgaccccattgttctgatcaggatttcgtatccgcatacgtgcaagatagactgtactggtggacatgcttccctgaacatctacctgcaaccataagaacatacaggaaaagtcagggaagaagatagatcccaatcagcggtattgtaaccagggaaagtaaagtagaaataaatactccttttgatgcaagttcggcattcaccccgtactcttctgacaacagcaccgtattcgcagcaacaggcatggcagcaaggaggacggggatgcccagaaggagcggatctgttacaaagggagatgttatcaggaacacaatcaccggaatcagaatcaaccgtgcggcggatattatccatacccggatatcggataccatggagaagaagggaagaggcgccagaaacgttccgatgacgatcatcgccagaggtgttgtgatggacccaaggagtgaaacagattcattcaggggagaggggatggtggtaccggtcccgagaaggcacaaaccaaggactgaagcaataagacctggggttaaaatccgtttcagatcaggattccgtgcaagatccggacgcagaagaaatactcccagagtaaataccagaaatccgaacgggaggttgataagagtgacataaaaaacagactcctccccaaacattgcataagccaccgggtaccccataaaccccagatttgagaagatgagcatgaaccgcaggactccggtctcaaagactgaccctgtcaggcaccaggggatgacaatggcactgatgaatgagacgaggtaaacgacgacctcaatgagagctatgacttccatcgagtatacgaggccgctcgagagggggacctgcatactctccaggataaggcagggtatggctacatttacaagaagagaagagagtcctgatgctccgctccgggtaatatatcccatgcgaaacgcgagaaatcctacccctatcagaataaaaagggtgaatatgcttgttgcaaccggaagaaagtccattcccagtaccttgttgttctgataaatcagaaaatggtcaggtatcaatcttcccttttctacaaggagggtctggacatcagaccagattcgtaaagaagatttattaatcagtcctgatgcaataggttttaggaatattcatgatggaatttattctacccggtgttctgattcttatcctgatagcacttgttgtctggtttgtatctctgtataaccggttttatgcactcaaaaattcatatgaagcgacccttggtcagatcaaggttgcccttaaaaagcggcttgatatgattgaccagcttctgggggcggtgaagagctatgccgcttttgaaaaggagacatttgagcgggttactgcaatgcgggcatcagtcggatctgctggagctggtgatatcgcagcacttgaagcagaatcacggacgattctgggaagactgtttgctgttatggaaaattatccggatttaaaaacccaggcaaccgtttctgatctgatgggcgctgtgaaaagtgttgaagatgagattgcccgccagcgatatacctgcaataacatcgccgagcagtttaacaccatggtggataccatcccttcaaacctggtcgcacggttttcaggtctttccaagcttcagtacctggagtttgaggaagagattgctaaaagacctgagatatccttctaattttatctggtctcaaggattatccggccctctgccataatcctgacctgcccgccactttcagagacgacaataccgatcgcttttgtctcctgcgtaattgcggcaactgaaacatgacgggttccaaatccttttgagagctggacattactggtatcaatagagatataccggccggctgcttcaaccgtcccgtcctccctgatgacaaaggcaccatcaagaagggcaagttccttgatgttctcccgcatgtccggattggtaatcttccgatctgttgaggaatgaccggcgagggggttcaggataagttgcctggaccgttcgaggacagcatcactatcaccaaggacaaaggcggtgcctaccggttttccttctcgtccctcccgggcaatctctattgcaagtttgatgacctgcatgcagatctccttatccccgtcatagtactctgcaatctggtcggcgatcgcgcttagctcctcgttggtaacaggccctgtggattgcctggtcaggacaaccgttccatctggagcaggacgccgacgaatatgatagagaacaagaccactgataataagcccgcctactccggtcccgatcaggatccagaagaacggcccgttcatcaccgactcttcaccagggggctttggaaactctccaggactgatattcgaggtcagaggttttgttacatttttattatcagagaaaaaccctggctctatggtcagcaggaaccgatatgagtcgtatgcctcatcatacatcccctgtctttcataacagatcgcacggtggtaccaggcatcggcataatacggatcgcgggcaatcgctttttcaaactcaaccagtgcagcctgacagttcccgacatcctcatatgcccgtccccattggaaatatgtctctgccgtctcattatttccggtcatggtactgactggtgatggggttggtgtggcggtccctgtactcggggccggtctcatggtcggactttgcaccggagggggaagggtcgggctcactccaggctttgggttttcaaccgggggctttaccgccggctccttggtatgaatcggagcgatggtcgctttggttgtcatttcatccaatggaacaggtgccgtaaccactggagtgatgatatcagttccggttaccgatgtttcagcaaaacagggggtaatatatgatactgctgtcagaactaaaataaacaccatcaggtaccggtaccaggagatggcgttcatagtagtactaaggtgctgattactgataaagatgtaaccggaaggacgtatcattttggggtttattaaattatttactcttcaatctgtatataaaagaaaaatgagagtctgatgagaagagaggatctagctaaatcctgcaatgatggtatgatcccttgttacattcacaaactggtattcagatgaagggtcaacattggaaccgtctatgaggagatactcgatctggtgtccctcatagggagtcagcacaaaggtaatatctccgccggccatcacttcaacagttccttccggaaagattgcgccaccggggccggcatatgcagtaaccgtgtgcccgggcaccttttctccggcaccattttcaatgactatggatgcaatcccggtttcattccctgaccgcatttcaggaagataagtgagcacgggcggtacaacctcatatggtgtggaattattggcaatatcaaccgactgactggaatcaggtgtcggtagcggggaggtactatcaggaatagtcaggatggcaggatcactgactgaaagcaccgccattgatgaattattcgatgaaagtgagggtgaaagttctctcagtgttacggcaataaccacggtttcatcagcagcaggataccgatcaatggacccttgggcagcggtcgcattcatcgccataaccttccaggaggtatataagggaatatttgcgggaaccggaaccgagagacttgatgtcatcactgcgtcaagtacgacctcctgatgagtgctggtggtgagaacaacctgattcccggggtttagcccggtaaagagaaggtaaccattttttactgccggagccgtcaccggggtctcatttgctgaaatattttctgcgataaccgtcccgttctcatccttcaccctgacgacctctgaacccagggctgaaaaggcagactcttcatcctgatactcattctggacagagattgcaggtgtggctgaaggggatttggtcgtggcattgatcgtctcattcaccacctcattggcggtctcattcgttttgaccggttcagacggttctctttcttctaccgacagtccctcactcgattgattggcaaccggttcttcttcagaggttgtgtttgtatctgcaggaatattatgttcaaattctgatgaaaccgcttcaactggttcaggggttggctcaggagttggggcaggataatttttatcggtatttgtcagggggagataatcgatattataagcattgatctcatatggtttgtcaccgattccatacccgtcctcatcaggaaccgtatcagaaaacccatcaaggcctggtgcagatccccaataattaccacctttatacggacctcccaggatattcacgccttcttcgagggtgacattccagacaatatcgctgctgatctcatccacggagatattattcacacttccaaagtagttgttgtatatcttcgcacccgtgaccccgttcccaatgactaccaccggaccggttgcagtctttgaaaagttattatcggtgataacagagtctgtggtgctttcaatctgaagtgctgcatatttattgtcgctgatgccgtttttggtgagggtaaatcctgatgagtctgtgacctgaacgccatagacatcacaggtgttgattgtattatcatgcaatgtgacatctgcggtcttcatgacgatgacgccaaccccgttgtttttcagggtatttttcgtcacggtaactttgctggaggtctgttcaatattaattgcctttgaacagtcccggatcaggttgtcggttataccaatgaaatctgaatactcgatatgaataccagtcgggcagtcgatgatatccaggtttgagatcacattggtatcaccctcttttccctttacatactggtaacttacaccattgttccagtcctcaagtttcaggttttttattgtgacattggtgatagaaccgccgaacttgttcacgtaaataccgaccgatttgtcccgctggtctccgcccagaaaatgaccctggccatcaagcaccacatcagatgattcgatcctgatcccatacatatcagtaattccccgtgcatctgcagtcagctcgtacatcccaggtgatgtgataacggcaggagcagttatcggctgtgctgtacctgatacactgaacgcaactaaaattaccaggataagatatcccagatatcggaatggttttcctgacatcacatacaccttccccatctttcggatcaccagtatctgatatacgggaaatcccaagattcttgtatttgttgtttatgaaaaggatcctataaggttctcggataagaagtcagatttttcagagatttacacacggtatcaattattaatccctgaaactgaaaagagaagacacggagattttatcaggagtattgaatattttccctgcaatctctgcgattcatagttattttccattatctcattcgcatgagttccctgacgacccggatattatctgcatcaccgcgccgatcatcaaccggtgtttcgcagatacaggggatattacgaaatcccggatgcatgaggactgaacggataccaggtacaccaagggtacccatgccgatgtgttcatgccgatcaagcccgctcccaagatctccctttgcatcattaagatgaatcacatggagcgatgtgagaccgatagtatcctgaatctgatcagccacctggccaaccaactccggggtccggagatcataccctgctgcaaaggcatgacaggtatcaaaacatataccaatccgattctgctcttcacaccgtccaaagacatcgccgatatcctcaatcgtgcttcccaccgaatgcttctctcctgcggtgttttcaagaaggagcatggtccccggttctctgccttcaagtgcggtatcaattgcctgaacaacccgtgccctcccgtgcgcacggtcatctccggcatgtcccagatgagtgataagataaggaatatgcagggcctgacaccggtcaagttccatcctcaatgcatcgaccgacttctcatacattgcagaattgtctccggcaagattagggagataggagatatgggcatatactgtccctggtctgaactgttcactttcgtggataaaggcatcagaatccggtttttcgattggtttcgccttccaaccccgtgggtttttggtaaaaatctgaaagcagtcgcatccccgttctctggcccggtcaaaggcatgtacgaatgacccggctatggatacatgaactccgacctgacgtagtgtcatggtactcatggatgaatgagaatggtcttctcttccaggtagtggaagagagcataccgcccgttttcccgcccaagacctgatgacttcacacctccaaaaggtacttcaggaggtattctcagatgctggttcacccatacaatgccggcatcaagctcctgggtcgcccgggatatcgttctcatgtcatgagtccagactgatgcaccaagaccaaaccgtgttgcgttcgcacgctcaattgcgtcggatatggagtcaaattctgatattggaagaacgggaccaaatacttcttcacgcatgaccggagcatcaggatcgacatcagtgaggatggtcggaagataaaagctccccattgcataggggtcagaatcaggtatcttcccaccggacagtacggtacccagccggttatccacggtctcctgcaccagggaatggactgtatcccgttgtcttttggaatgaaccggtcccatatccacaccagctaaaagcccgtttccaacctgaagtgcatcggccagttccctgacccgccggacaaagggtgcatagatgctggtatcaacaaataccctttttattgcagtgcaggtctggccacagttaaagaacctgcctgacactgctcctttcgctgccgcttcaaggtctgcatccttgcagacgatcatggcatcactcccgccaagttcaagaatagtcttttttaaggtttttgctgcatgctctgcaacctgaatgccagtcggaacagcaccggtgaatgagagcgatttgatatccggatgacgggcaagtgcctctcctaccacctcccccgatccggtgaccagctggagaactgattcaggaacgccaacacgatacagacatcctgccaaggctttacaggtcaggggggcggtcgttgaaggctttacgatcatcgtatttccggtggcaagcaccggcccaatcttccaacccatgatgaggaccggcatattccagggtatgatggccgcacagacaccaaggggctgccgcacaaccatcatgtgcccatacgttttgctcagcccatagtcacccttcagagtgccggagattgaagcataatactccagcacccgggcaaatcctgctacttcattcatggattcacgaagtggtttaccctgctcccgggtaagcaggcgggcaagatccttttgatcagcccgtacaagctgagctgctgaaaagaggagttttgaccggtcaaggggatcggtttgagaccaggaccggaaggcttcccatgcggtactgaccgcattattcacatcatcaggtgttcccgcaggaacgctgccgacaagactcccatcagcaggattatagacctcatatgattcctgattcataggagcctgctttgatgtcatgctcagagattatgatgcatgaataaaaatctcaatggtcaggtgtaaaaagagaggagatcaaggtcagctgcagactgtcccatacatacggtcaagtttctgcgcaattccttcccatctgaactgccggtacaccttggatcgtccggttctgccaaacttagagagacgatttgtatcttcaagggcctggcatataccttctgctaaccggtcagctgagacaggaacttttatgccatcccgatatgactcgatattctcatgtagcccgccgacatcacacgccaccaccggtcgtcctgcactccatgcctcggggagtactatcccgaacggttcattcctgcttggtatgacgacaaggtcagccgcgttaaggagccggacatactcggcatcggtgatataccccgggaaccggacaggaagaccccgatcatatgcaacctgttccagccacggacgcatgcctccgtctccggccatgatcacctgcagtccccagtattcttcctttaccatcggaagggcatcaaggagaaggtccgggcctttctggtatgccatccgtccgatgaagaggatggtcggtgcataggggtgaattcccatctcggcttttaatgatccctgatcaaggtctacatcaaactgttcaggaataactccgtttggaaagacacggatcttccagtcaggaacctgatacaggttcataacctcctcacggagaacattgctgacggtggtgacctgacgggcaatcaggcctgcataccactctttcccgcatatctcatggtattcccaccagcttccgtgctgattgccatttcgtccatattcggttgaatggtacgtgaagatggtatttctgtcctgcagaaggtgtaatgcttcagttacatgccagtcatgaaagtgaaggatatcaaaaggagtcccatcatactccctgaaccggttcaccatggcatgactcatgttccggcagtattcaacgatatttcccccttccggtctgaccccatggtaatgcacaccgttgaaggaaaaatcgcaatcccctctggtaaaataatgaacttcgtttcttttcgccagctcctgagctaaatatgttgccgcgttcgcaagtccacccactcgctcggagtacaacgactcccaacagaagaatgcaatcttttttcgttccacgtatatgctccctgatatatcatccggtagagatatctaccatttttgcggaatattcgatgtcagttgtgtgttttactctgtttctggaaggtcttactttgccatcttgtccactgccccctcatgagggcagaacagaatccaatacgacgtgataacatatatatgtacttatttgccgtacattaaaaagacaaaattatcagatcttgtctggatctcactttagagcgcctcacacggttttcaagacttttcataatatatgatactataaaatatatcacatgtattttccatttgtgtaatagagacaacaatgtatatatatgtacattatcttacatatatgatcatgataagccaggtattccaaaaggtgatgccggtggaatggatactgccatgaaggcaggtcagtccatggggattttcccatttcaattgtatgagaagatcgccaaatccgcactacaaacgacctatattccggtttttcttccaataccggaaccatctgtgaatcctgcagagatatatgctaccctgtcacaggaacagggttttttacttgagtcaatggaaggtgttccaaaacgtgcagtcagatcaatcatcggagtaaagccactcgcaacactggcagtttctgattcatgcataatatccggcaaggagggagaagtatttcaaaatctgctccaggatcaggagataacatccccgactgatgtgctccggataatccagagagaattatctgcatatacaccagatgcaggcacattttctggtggtatggcaggatactgccggtatgatctggttcgggacatcaccggagggatggtacaggcaggacaggaggagggcccggttatcagactcatgattccgggggatctcatcatctttgatcatgttgcccactcctgtctgcttattgcagggacttttattcagaaaggggacaattatcaggaaaaatacgatgatgccgtcagaagagtgcacacattagagcaggagattgcaaacctcaaaaaaagagcaccaatccccacagtcatgtatgagaaggtgcatcttccggatcatgacagggatctatacgaacatgccgtggaacaggccctgcagcacatacgggcaggagatatctttcagatcgtcctctcacgaagattttcacttccatattctgctgatccatatcggatttaccaggtactcaggacgataaatccctcaccatacctgtattatttcaattttggtgatgaagccatcatcggatccagccctgagatgctggtaaagactaaaggcaggacggttatgacggtcccgattgccggaaccaggccgaggggaaagacagaaactgaggatgcacaacttgcagaagaactcctggccgaccccaaagaacgggccgagcacctgatgcttgtggatcttgcacgcaatgacatcggcagggtatctgagtttggaaccgtaaaggtccctgattttatgtccattgacaaattttcccatgtccagcatatcacctccgtagtcaccggagaacttcaggcagagaaagggccggttgatgtactggaggcatgctttccggcagggaccgtgagcggagcaccaaagatccgtgccatgcagattatccaggacctggaacctaccccccggggaatttattcaggggcagtcggttatcttggatttgacggactgatggaatttgccatcgcaatcagaacagtaatcgtaaaaaataacattgccacttgtcaggctggtgcaggaatcgttgcagattcggtcccgtccaaagaatttgatgagacccaggcaaaggcaggagcaatggcacaggcaatattcaccgcaggaagattaccatgaaggtcgttatcattgactgttttgacagttttacctacaatctctaccagctggtcggatcccttggtgctgaaccggtaccgatcacctgtaataaaccgttagaaaccatacaaaaggcagatccagaccggattattctctcgcccggacccggaacaccgaaggattccggggtgtgcagagaggtcatacaaacatacatgggaatggttcccatactcggcgtatgtcttggacaccagaccattattgacacgctgggaggtgtcatcaggcagatggagcggccggttcacgggatgaccagtgagatccataccaccggagaaggaatatttaacggcgttccggattcttttcctgctgccagataccattctctcacggccgaaccaaaaacccttccctctgtcctgaaagtgactgcaacaacacaggatgaccagacaatcatggcagttgcccaccggaaccatccggtatatggcctgcagtttcatccggagagtgtgatgactccggcaggccgcaccatcatgaagaatttcctcaggtacggaggtgaatgctgatgattcaggatactatcaggaaagttgtcagtatgcaggatctggcacctgatgaggcccgggacctgatgacctcgattgcagacggaaaggtaactgatgcacagattggctctatactgaccgctctttcgatgaagggggtgaccgctcatgagataaccgcctttgctcatgtgctcagggaccgggctgttcaattaaaaacagatacctccggaaccttcgtcgatacctgcggaaccggcggagacggggctcatacctttaacatcagtaccgccgcagccctcgttgcagcagcggcaggtgtcagagtcgtcaagcatgggaataggggagtgtcaagcagatcaggatcggcagatgtactcgaagcccttggaattcccatcaccctcacccctgaggaggctgcagcttcggtctcatcacataacatcgcattcctgtttgcccctgggtatcatcctgctatcgggagagttgcttcagcacgacgggagatcggattcttctcggtctttaacatcctcggtccgctgctcaaccctgccggagcttcggcacgactgatcggtgtgggagatactcggcacatcccctccataaccggggcactggcaaaccttggggtatcccacgccatggtggttcatggagacggcaccgacgagattaccatcaccggtgagaccgaggtttatgaattatcagggggaaccatctgcaggtataccctgacacctgaagagttcggaattagacgggtatcgcgggaaaccatcgcaggaggaagccctgcagagaatgcagagatcatcatggacatcttctcaggaagaaaagggccctgccgggatattgtcctcctgaatgcagcagcagcgatttaccttggagaaaaagccacctgcatctatgatgggtacagaattgccagggaagtggtcgattcaggacaggcataccggctggttatggcactcaggagaacaacatgatccttgatgatatcgtcgcatcagcccaccggcgggcatctgagctccccggcttctttcagacaccctctcatacccccatcagtctgaaagatgcaatcattcagaaacggagaactcatgcacatccggttattgctgaactcaagtttgcgtcaccttcacgggggatcatcagaagagagacaaagcccgaagatgttgcaactgaactggtgcatggaggttgctgtgctctttcggtcctgactgaacctgaatacttttccgggtgttcagcaaccatcccggccatcagggacaaggtaacggttccaatcctcagaaaggacttcatcgtggatgagcagcaactggacgaaaccagggctcttggagcggatgctgtccttctgatcgccggggttcttggagaagagaccgggcactttgtcgaagcaacaaaaaaacgcggtcttgaacctctgcttgaagtacataccagacaggaggcacgaatggcagtcgataccgacgcagaactcatcgggataaataaccgcgaccttcggacattcaaaaccgacctgtccaccacaaagcgaattgctcccctgattcatcaggcaggcagaaccgttgtatctctgagcgggatgatctggccctgtgatatcaggtttatgagtcattacgcagacgggtttcttatcggatcaagtattatgtcctcaaaaaatccaggaaaaagagtggagggattggtatacgcataaagatctgtggaattaccagacctgaagatgcacatcttgcagataaggccggagctgatgcaatcggggttgtcctcttctcagattcaccccgtgaggtatctcttcaaagggctgcagagatattcaaggctgccggaccatacatgggaagggtctgtgtatcgcataccagctcagttcaggacctggcacagatgcttacccttcaaccgacggccattcagatatcccatccgcataccctccccacgaaccgcccgtaccaggttatacgagtcatacagccgggtgatccaatacccaaagatgccgatgccgtgattgtcgacgcaagtatgggaaaaggtgccctctacgatcacgattacgcacaatcaatcatatccatgtctaaaattccagtcatacttgccgggggattaaacccggacaatgtgaaagaagcagtacgattacgaccatatgccgttgatgttgcatcaggtgttgaatcatcacctggcataaaggatgcacgcaagatcatggcatttgtgaaaaacgcccgggaggcataccatgcagcttaatacccgacttggggagtacggcggatgctttgtccctgaaaccctcatgggagccctggaagaactggaagatgcattcctgaagatcttcccgggatcggcctttcaaaaagaactcagcaagtacctgacaacctacgccggacgggaaacccccctgaccttctgtaacaacatgtcacgggatctcggatgcagggtgtacctgaagcgcgaggatctcctccattcaggggcccataagatgaacaatgccctgggtcaggcactactcgcaaaatatatgggtaaaaaacggcttattgcagagaccggtgcaggacagcacggagttgcaaccgccatcgccggagcggtccttggccttgaggttgacgtgttcatgggtgaagtggacattgcccgccaggccctcaatgttgccaggatgaatatgatgggagcacgggtcatcccggtcacatgcgggacccggacactcaaggacgccatgaatgaagcactccgggactgggttgcccgcgttcttgacacccattatctcataggaacggtcgccggaccacacccctaccctactctggtcagagacctgcaacgggtcatcggtgatgagacaaaaaagcagattctggcagcagaaggaaggcttcctgatgtcatcatcgcctgtatcgggggaggatccaatgccatcgggatctttcatccgttcatcgaagataaggcagtcaggatgtacggggttgaggcaggcggagaggggcttgaccggaaacatggcgcttcactctgcggaggaagaccgggtgtgctccacgggaactattcctaccttctacaggatgcattcggccagataattgagtcacactccatatcagccgggcttgactaccctggtgtcgggcctgaacatgcgatgcataaggattcaggcaggattacatacacggcaattaccgacaccgaagcacttgaggccttcctgtacctctgtcggacggaggggattgttccggcactggagtcctcacatgccgttgcatttgcacgaaaactggcaccggatctctcagaagataccatcattgtaatcaacctctccggacggggagacaaggatgttgaaaccgttcgaaggtacatggagggcaagcaatgaaccgtctgaaagaggcatttgaaaccaggacgaaaagccttcttatgaccttcaccgtcgcaggagatccggactttgaaaccagtcttgagattatcaaggctcttgagaatggtggagcggatatcatcgaacttgggcttccgttctcagaccccgttgccgacggcccggtcattcagcaggcagaccagcgggcacttgcatctgggatgaataccgaccggttctttgacctggtcagagaagtccggaagagttctgatatccctcttgtcgtcctgacttacacgaacctgatcctgcagcgggatatcaatacattctatcaggatgcagctgatgccggtatcgatgccgtggttgttgcagacctcccatacgaggaggcaggcccctatattaccgcagcagaaaccgcaggggtagcgccggtcatgatggtcagcacgaccacctcacctgaacggctttcaaaaatcctcaccgtcaagagcggatttatctacctggtagcggctcttggtgtcaccggtatgaggcagaagaccgacccggttgcgcaaaaactgcttgccgatcttaaaaacaggacagacatcccaatagcccccggatttggcatatctgaccgggaacaggtcagggaatggactgatgcaggagctgatgcggtcatcgtgggttcggccctggtcagagaaatcgaggatagtcttgtcaaaccagatacgctgatcccccggattacagcatttgtacaatcactcaaataatagtcaggggagactacaacatccatcatgggtgagcgggagacagatcataaaccgtgaaccggtatccttcccctcactctctacccagacttttcctccataacactccatcacccgttttacgatagaaagaccaaggcctgatgactgacggtcatgcctggaccggtcggccatgtaaaattcatcaaatacatgaagggcctcttcctttgtcagaccaataccggtatcctcaaaggtgatgattaccgcctgatcatccacctgggaatagatacgtatcctgccattgttccgggtatatttaatggcattactgagcaggttttcaaataccgatgaagcatcccggttcgaaaaactcatggtgagatcatcagggaccagcacttccacagtgaggtttttctgctcgataaagagccagtgtttctctacggcctgattgataaggctggccggacggatcatctcaaattcaaccaccccttcatgccgactgagtcgtgccagggtgaggatcttctcggtctgttccctgatagaatatacagaccttagaaggacaccataaagttcacgtttctcactatcatgctcttcatgaagaagggttgggagcagagcgatcagaggagtcaggggcgtcttcaggtcatgtccaagctggttgataaaatcatctttctgtttcagaagccggtttacttcaaaggtccgctccctgacacgatcatctagttcccggttcataccgatcagccggttggctaaaaagtccagttcatggtttttatcttccagaacccgggcatactccctgagctgggcttctgcctttttccgttccctgatatccctcgcaatcaccagaatggcaggctctccacgatatgtgatggccatggtcgagacctcaacctgcacaacctccccggtatgactgataaaacattcctcctgagggggatttaaccccattcctgacaatgaagaagatattcgggtattgacaagaggaatgtaatcagggtggacatatgcaagggggtcctgaccgagcacctcctcttccttttctgcaccaagtaacgtgataccggcaggatttgcatagaggatctgttttccgtcatgcacaaagataggatcaggggatagttcaaccaacgtcctgtaccgttcttcactctcacgaagagcctggttgacctgcatcagttcactggttcgctcggtcaccaggatctcaagctcctcgcgggactttttcagggcctcttctgccttttttctggtggttatatccctgatgcattctatcgcaccaacgatctcaccatcagaatttcgaagcggagaagctaccccccacaggtacatcccttctttcccagctctgttcatgtacgactccccgatgataatatccccctcacgatggaaatgtacgtatttcttccgggttacatcatccggctctaatgcaagatcgaccagaatcggccttctctcaccatagaacgggactgaatatgcataattcccttttccgagcatctcctctgccgctatcccggtcagagctgccattgcacggttccagaatatcacctccccgtgtttgttgattaccaccgttgcatcagggaaaaagtcaataacatcagcaagttgttgttttgattccctgatctcgtcttcagccttttttctctcagagatatcaataatgacgccacgaagcccggtcaccgtcccgttcacaatcacggctgtggaatggatgattactggaaatgttgaaccatcagacctgattgccatatactcatgcggcttggaaggagcacctccactgacatctcggatgatctgaaccgcccgttgtcgatcgtctggaatgataaaatccagtacatttttatcatccaggggctggtcagcatcaaatccaaagagagtatacgcctgatggttgacataggtgatatttccattcagagagcactcaaagatcccttcagggaggagatcggcaagatccttgtacttttttttactctcctgaagcatctcctgggattgacggagctcttccagacgaaacttaagttcttctcctgatgcgataagctcctcatatgccgcactgagatcgatattccgctgttcaagctcattttcagcctggatacgttcggtaatatcccggataattgcctggtaatagatggactcccctaattccagtttgctgacactcatctcggcatcaaataccgaaccgtcaaaccggcgaaacttccacgtgacaaaggcgccatcttcctgaaaagcagtctgcaacaaagcccctgccttatctttggtcctgcttccttcaggctgaagctcaggtgccagcctggtaaaatcagacccgatcatttcgctcttgccagcattgaacagtgctgctgcctgattattacagtcaacgatggtaaagtcggaaagcagaagaatcccgtcaaacgcagtttcaaataatctcctgaacttctcctcgttctctaacagagctttttgtgcatcttgtgcatgaacagcctgacgtatcttatgggcaagttcggcaaagagagagggtggatcaccccctttttgcagataaaaagttgcgccctcgttaatcgcctcaatgacgacctcttccctccccttgccggtaaagagaataaagggaacgttcaccccttttttacggtacgcccttaaaagatccattccggacattccgggcatatgataatcagagacgacgatgtcgaacgagccggacaggatcatatcaagtgctttaaaccctgaccgtacggtggtgacggtaaaaccgtccatcctctccaggtataacttgaaaaacccgcagaaggattcatcatcatcaacgtacaggactgatatcatcggctctgcaatctacctgatacaactgtaggacaccggttcatatcaaggtgcggacatcgatgcacaccggcaggtgataatgaacttcttaaagatcagagatgtatgatatcatcatgaaatgggtatatgtgctgttctttcttgtaatgatctccgggttctggtcggttgttgcatccccggcagatgaactggcagcacaggggaacatgctctatgatcaggaccagtatgacgaagctctcatcatactcgatcaggccctggcaatcgaccctgaacatctcgaagctttaaacgggaaaggaaaagtcctgaaaagtctgggaaggtatgaggaggcaatacagcagtatgataagataatcgctgttgatccaacctataaaaaagcctggaataacaagggaatcgccctgacctacctgggaagatatgaggaggccattgccatgtttgatgaatcattacggctggatcctgaatatgggaaggcatacagtaaccgggcctggtgccttaaccttgccggacgatttgaggaagcattggcatcagcagataaagcaaccatactcgagcctgattatgcacggggatggagcaaccggggagatgccctctctgctctgggccagtatgccgaggcagtaatgtcgtatgatactgcgcttattctggatcccggacttcttgatgccctggaaggaaaagagaaagcgatagcaaagatgtcataaccggctcattccttttttcaatctacataagatcccagagtgcctgggatttacaaatgaaaaattgcaaaaaatcaaacgcaaaccagataccattccgaatgaaaccatacatacatgaagattcaggcagtccttttgcttctcatcatgcttttcctggtacctgggggagtggtatcagaggaaaaccagtccgcacagaataatacaacgagtgcaaacctgaccgatgtaccaataattcctgatatttccccgcaggagaaactgatgaaccgggcctttgaagcacgtgcatttgcactggaaaaagggaaggatacagcattggcagaattttccaatccctccgggcagtttaactctgaaggtatgatcattattgcatatggtaccgacggcgtccttcttgcagacagcacacgaccaggcgaagtcgggtcccggtttattgcagatgaccatgacgccggccaggtcaggatgatgcgggatcttgcaacaacaggcgggggcctctatacagatgctgcaacagggaactcctggtttgtatcagacgttgatggcagctggtggatatgtgcagccataacccggaatgccggtaaacagccctgattgaaaaagcccacaggaaaccatatgattctaatcaggaagcggagtatcggacaggcccacgaagaggtaatcagggagattgccaggcgatgtgaggggcaggtcagggtaactgaagatggtgaatatacctgggatccggaagagccgatctgcatacacgtggaagagccttttgcagagccgatgcgttcaggagcatcactttttggagagaaattctctgaacagtaccaggcttccctctatacgattacaccgcgccgtgacgacgggacggatgccgtgtatacctatggcaaccggcttcgtgattatccgaaagctgaggtgggaatagtcagcaaacacggaggggcggtcaaaaaagccatcgatgccctctttagaaagctgggatatgttccagctgatgcatgcggggagcttatctggaagggtgacggacgatatggggggattgaccagatacaggagagcatcattaaccggctgattcaaaaccctgaaagccgtcgtgcaatctcaattacctggttcccggttcaggatatcaccgctgatgagcccccctgcctgcagctggtgcagtgcgtcatcgataagaataatcatctcaacctcatctgtgtcttcagaagtaatgacatgttatcagcctggggtcagaacgcatacggccttgcccatctccagaaatttatttgtgaacagattaacctgaaacgaaaaaacgccgaggaaaaagtctcacaggggtggcttgaaacaatcagtatctctgcacatatgtattttcaccgggatcagcttgaactcaacctgtttttggagaagataaaaaccggagaactctttcagtctttccagcgtagatgatcctgacaagtcatccctttctccatttgacttttttcagaaagaaaagagaaaccatttatagtgacagcatgatatgaaagcgtatggtgctcatactggttgcagatacatggctctttcatctgaaccggtagcatcagaatatcatacactcttcacagagggaggtatccggcgtccggggatacctcactgcctgtaaattcctcgccatgagtagctaaaccagaaggggactatttacttatgaatctgatggtaattgttctgacaggaaaaataatgggcagatgagcctcctgttccgaaataaccacgtacgccatcaacattcctcttttaaggaggcattctcgtttataaaacaaaaaaatggaatgtccatcgccagactgaaatagccggtatcatcctttcaggtacaggtatctgcgacgctatctgcctgagaagagctgatttttcatatctttttgctccggatatgatgactccatcaatgtgattaaaaatcccatgaaaaattcgactttttctttggccttatgagaaatcgcccaaaaacatttataggataacaaatcgagagatatcctatgcaactagccgagttccgggttcagaactataaaattattgaagacaccggatgggttcctgtccagaacctcaccacatttgttggaaagaacgaatcaggaaagtcagcaatattccgggcactttcaaaactgaatccttcagacggggaaggatatgacggactgaaagaatttccacgccagcggtatgcggcggagataaccagaaccgactggccggttgcctcgggcaggtttgtcctcactcctgatgaacagcgtgatatcgctgcgatatcggaattgtgcaatgaagtcagatctgtcgaggtcacccgtcattataccgggacatacagcatcacctatcatcctgatgtcggggtagatcttgtcactcctcctgacctgatttatgcgattgaaagtgctattgaacatatccgtaacctgattgctccggaggggaagggcgaggaacttggtcggataaaagagggacttttagcatttctcgaagagcagaagggtgcaattccggttgaaggacaggttcacaaacggcatattgcagatcttattaacgctattaaaagcagggccaacgaaccatggcagcatgatatccttgacccggttaccgaaccgatgtaccgcctggtgaggcagatagagatttttgaagggctgatggctgcaaaccgctatgtgattgagcatctgccaaaatttgtctactttgatcagtacaatgtcattgagagtgcgatacatatcccgacatttattgcaacgctcaaatcccatcctgacacccccggtcttcgtgcaacccactgcctgttcaggcatgtaaacctcgaccttgatcagctagaccgtctcggctctcacaagaatgcggtagatgacaacccgatcatcagaagacaggttgatgagcgttcaatcctcctctcaacggcctcaaacctcatgacaaaaaagttcgaggactggtggggacagagaaagattcgattcaggtatgacattgacggagactatttcagagtatgggtatctgatgaccttgatccctcggagatagaactggaacagaggagtgcaggtctgcaatacttcttctccttttacctggtattcctcgtagaatctggtgatgcataccaggacagtatcctgctccttgacgaaccaggactccagctccacccgactgcccagcagcaggctacccggttctttgaacgtatctcccaccagaaccagatattcttctcaacccactccccgttcatgatagacctcgatcatcttgaccgggtcaggactgtctatgagggtgaggacggaaccacgaaagtatcagtatctgaatggcctgcggatcgcgattctctcttcccccttgaagcagcccttgctaccaggatagcagacagaaccctctctggtggaaagcagctggtcgttgaagacacccatgacctctggctccttcaggccatgaattatgttctcaggagcagagggaagaccggcctttctcctgatatcagaatcaccccgaccggaggggcagcaaacctgatacccctcgccctgatgatgacggcacataaaaaaccagcagcagtcctcctttccggacacaatatcccacaaggcgttcttgaaaaactcccatccatgcatatccgcgaggggagcggactcctcctctatagttcgtttgtaaaccgtcagggtgccgggatagaggatctcttctctccagagttttattaccggtgtgtcaaggatatatatcctgatcttccacttggacagatatcagaaaaaagcccggtcgaacggaatgaagagcggggaattgcccatcagatagcggacctcgtcgaacgaaggcagggagagcattttgaacgctggcgggttgcagaactgctctccgaccggatatgcgaatctccccagaatctggacgatgagacgattgaccgtttttcccgtctctttgatgagatcaaccggctgatataaggattcagaggtccggaccctctgccttttttgatgatgcaagatgtgataggactgcccgtcccacttcctcagttgttgcagtacctccgagatcaggagtctttatcccgtcggcgatggtcttttgaatcgccttttccacttcaatagcactgggcttctctccgacatacttaagaagcagggatacacatctgatggctgcgatgggatttgcaagacccttcccggcaatatcaggggcactgccatgaactggttcgaagagtgcctgatgccgtccaatatttgcgctgggaagcatcccaaggcccccttccagaaatgcagccgcatctgaaaggatgtccccaaagatgttcgtcgtcacaatgacatcataccggcctgggtgctgcaggacgtcaagaaccagtgagtcgatatactttttatctatggatattcctgccttttcagcctcctccatgcagatatcaaggaaataagagtcagacttcaggacatttgccttattgccgattgtcagatgtcttcgtctccgcttggcacagccacaagcaaatctggcaatccgacgcgatcctgcttcactgacaacacggagggtacaggcacgatccttctcctgccattcgatacctgaatagagcccctcggtattctcccgcacgatcaaaatatcaaacccttctccgaataccgggcggagatttgcatagagatccagttcctttcgaatccgtagcaccacactgtgatacttcggatcaggaggtgttgtaatcgcaccaaacaggattagatccgcctttttgagcgtttcaagtgtcctttgtgacaatgcatctccggttctcttccagcactcataccccaaatataccggaatatactcccactcaggatgaaagaaccgaagcacctcaagtgcagaaggtattacttcaggtccgataccatcaccgggagccacaacaacccgcttcatccattcctccattcatgaatacatgcatacacggcatcggtgatctgtttgggggatgcaccccagtgaaccaccacacctttctttccattcaatgtctgtaccccgctgcgttctgcacggcaacatcgtgcaataaacggttcttcccgtactgcatttgccgggcagatatcaatcagagggaaatcatgcccatagcagtccctgagcacctgtcgtgccgtcatacaccctgccacctgctcatcaccgacaagccggtcagaatcgatggtccgggaaaacccccctgccttacagggatatgcatctgcttttgtctccctgatatcattcacatgataacagaatcggatctcaagttcaccgaatatccctgccttttcaagaacctccagagttccggcaaggtgcggatggggaggtgtgacatcatagacatgaaccgtgagcagggatgcagggtccggatcacagataaagatcttatgctcctctatcccggtgaagatggtgcaccgtttcggactttgaagagctttctgaatcaaatctccccggttatgaagcaccaccggatccggatacaggtatacctcatcaggccctgcaatccgggtcaccgaggcaatatccctcatcagtccgtccccctctgcaggctgtacggctaatatttcaaatccaccgggaacttcatggatcagatactctgagagaaaatacacgcggtcccctaccggtttatttccagcatacccgatgcatttgcagtggggggggaagatcatcgctcttttctccgtttccagtactcaatcagaccgccggtgctgagaatctcctgcatccgtggagagaggggccggaagagataccgcgtcccatccacctccacccacccttcagtgcaatcaaaagtgatgatcatgccatcggtgcatccggtcagatcacattccagtaacggaagcccgacattgatgcagttccggaaaaaaattctggcaaacgaaggggcgatgacagcaagaactcctgcctcatgcagagcccgggccgcctgttcccgtgaagacccgcaacccatgttctttccggcgacaagcactgctcctttcagtctttcggcaagagaaggatcaagatcctcaaacacatgctgtgcccaaaaactccagtcttttgttctcaggtatcgtccggcaatcaccagatccgtatcgatatcctctccgatacagactgcagggccggagcctttgagagcagtcatacaacctcccttggatcagtaatctcaccatatatggcacttgctgcagcagtggagggtgaacagagataatacgaagcccccacacccatccggttcttaaagttccggtttgcggttgaaagggctacttcaccctcacccagaacacccatatgggcaccaaggcagggaccacagccgggcggtccgatggtacatcctgcctgcacgaggtcagcagcaacccctgacaaaatagccttgaggaaatcacgctctgatgccggaacaacaatggttctgacttttacccggcgtcctttcagaatcctggcagcacgtgcgagatcttcaaaccggccgttcgtacaggtcccgataaagacctgatcaagatgggtacctgcaagggccggaaccggttggacagtatccacccggtgaggaaccgcacataccggctcaatatctgcgagatcaagatagcagtcctgcacatagtccgggttttccaaaacctgcatcggacagggaacagaatactctgcgagatatcgctctgtctccttgtctgcataaaagagcccggtctttgccccggcctcaaccgccatattgcataatgtcagtcgtccttccatgggaaccgacggagtggattcaccaatgaactccagggctgcataggttgctccgtccatcccgagccgtgccacataggtcagcgcaacatccttccactcaacgccttgctttaaggatccggagagatgaatgccgattgaatcaggaaccctcagccaggtctcaccagacacccagatacctgccatgtcacttgccccgacgccggttgcaaacgccccgagagcaccgagtgtgcatgaatgagaatcagctccgatgacaacctcccctggtgccacctgcccttctgccatcacctgatgacatataccagagccgatatcccagaaatgcaccccgcactctctggcaagggtccggagctctgcctggagttctgcagtctgggagttgttcgccggagcaatatgatcataaataatgtagacagaatccggatttgcaatacccggagcccccattgcatcatagattatctttgcctgaatcccggtcccgtcatggcagaatgcccggtcaatatgtcgatcaatatacgtgccggccggggcacctagaatcttctccgataatgtcaccattgatcttatcctccccggttacctgggagatgatctccgcaagcacccgctggttgatactgcatttatcctcacttttatcctttatcaattcaagaacctgcataacctgctcatcggtgatgtgatagccaaaagaagtcagaatatgcaccagagcacgctttccggtatgcttccccaggataaaccgccgttccagtcccaggagctctgggggtatgaactcgtaggtctccggattttccagaatagctgcaatatgaatcccactctcatgggcaaacgcattcgcaccgaccaccggtttcgttgcaggcataaaaatcccggtatactgttgaacccgttctgaaagagccggaatctctgtgagatcataccgggtaatcccgcctttgagcacgagtgataccaaaacctcctctagccgtgcattccctgcccgttcaccaaggccgttcaccgtggtatgcaactgatacgctcccagttctgcggcaatgagtgtatttgccgtcgcacacccgagatcattatgagcatgcatggcaatcgggatgggcgttttggggacaagatccttcatgaccgtagcgacctcaagaggggtcagacacccggtcgtatctgcatatgtgacataggtcgccttgtgatctgctgcctgccggtagatgtcaacgaggatatcagggtcggtacgggatgcatcttcagcaccaaaccggacgataagaccatgatccaccgcataatcaagctgttcaagagcatttgcaacaacaacatcccggggctttttatgcttgtatttcagatgcagatcagaaggggcaataaaaagcccgatcatgtcaacttcagcatcaagcgctgcatccacatcctccctgcaggcccgtgacagaccacatatctttgccgagagacccagccgggagatattccggaccatctccttttcatgggcggatacaataggaaatccggcttcaatcacctcaattccgattgcatcaagccgggatgcgatatccttcttctcatcagcagtgaatgatactccaggggtctgttcaccgtcccgaagagtgacatcacaaatttcaatgtgccatggtttcatgtgcgttgttcctccggacaatctccctgaatgataagcacccgtagcgtggtatcagggaccaaaagtcctgaaattttttcatgttcactggcattgcaccagaccggatttgaaaaccccagataggtgcagacatccggaaccggctggcggcccgttgttcccatgcaccggttctgcaagacaatacagagaagtggcctgcctttagcatgcagatcaatcagagcctggatgcctgagtggagcagggcataatcaccggtaagtgccactctggtggattgtgcagcaactcccaccgatgatcccatcccgtagttggcaatcccgaatctgtatggcgggatcatggagagaaggctacagccagtatcactgatgacagacactccccgttcctgcaacgtatcaaagacaaaccggaacggacaaccaggacagaacatccgtgatgagccccgttcacgacgtgataccggactgtcgtcatggaccagtggtgagatcggaaacggaagatacccggattttatcatctccgggaccgctgaataggcacgaaccgcacgaccatacatggtcagatcagggtcggcaagcgtcccacacgtactcctttcagatccttcagaacgtccctgccatgatctcttcaggtcaccggggatgaaccggacgatggaaactctggagaactgctctgatgcataaaaggcctctccgaccggatcaataccagacatatcaataaccggacagatggcaactgatccccacaaccgggagtcctgcacggtctgggtcccgtatgcattcggatcgtctccgacaacaatgacgatcccggctttcagaccctgggcggttgcatgaaccagagtatcggcaagcacattcatcccgacatgcttgacaataacacaggatcgcttgcctgatagcgaatccccgagtgcatattcaagggcgaccttctcattgatgaccagttctgccccggtctcttcaatcagggtcgtcaccggatatccgggcacggcatacaccgaatcagcatatgcctgtatagcatccccaagaccggatgtcatgtatccctccccggaatcaggtcacatccggtgcatgccggacacatggtcagggctgctgtgggatcaagaccatattttcggagcatctcttcatgaatccgggctatccggataatccgatccggatcaggggcatgaaaaccggtcagatccccgcccggcgtcaggggcctgataaccggcagaatcccattctggcacagatactcgatacatgctgccatctcctcatcagtttccccaaggccgaggatgacgttggaaaagacatgatttcttccaaacaaaggaactgcagcacgaagggcagcgattgcatctcccctgacaaggccaggacacatgacagaaaagagctggccagttgccgtctcaaggttgaacttcacctctgacactccggcttttttcaggcgatacggcgtctccgggtcaggatatattgatactccaatcgggagctgaaacttctggagccttctcacaacatcaagcgtataccgttcctcttcatgaatatcagtcaggacgccggatgtcagggatattgcatcaatgtctggaaatacagataaaaccatcgcttctatctcatcaatactccgcctgggtccgggatttttccagacattacagtaccggcactggaagatgcaggagccagtaatggtcaggtatgcctggcggggacaatgaagtccgggtttttccaaagatccggaatactcctctccttcaaaacggagaactgcctttccattccctgcatggtgcagctcaacacggctggtttctgaaaggctaagcctgacccggtggccatccatggaaaaaaataccgaaccagacgttcctgcccccgggccggcacgggaacgtgcgatatagtcatctgctgaaactccggtcaggtgtgtagtgcctgcatgtaagagcctggccttcagctctgtccacataattgaagaccctcatcataccgggtgtaaaacgggatcgctgcgattgcacccgtaattccccggccattgatccagattttcagatcatcaccggcaagtgccctcgcatcatccggggtaacctgtccggattttgtccgccacccgtattctaaaagacgatccggagaaaatccggtaaagaccgccattccggtttcttttgagagagtgtactgcatcaggagctcggaaaatctcctggcaagctcctcgggattgctgcttgcaaattctgcaaccacaccgacacagttctttgtcctgaacgggaccggaaagagctggactattgtatgtgagaggtaccggtgcctcttatctgcaaccgtccgggcaatattgtgaacaagcgtccatgttgctccctcctccggggtgtctgtgtcatcaactccgataagcacccggctcattcggggaagaactatcgttgatccggcaacttttcccccgcctgattcatcatacgaagaacggatcactccctcggcactcgcccggcagatggtggcaccaaccccgccaccacccatcccgatataggagatagcaatctcatccccctctacactgacttttgagataccagccggaaattttgatccttcaagggcaaggtcaacctctccggtccgcagaagaaaccgattcatggaaccgacggtccggacgccggtgacaagtggcgactttgcatagtgctttttcacccacatggctccgccgatacagtcaaaacactcgataagttcaacctggcctcctgtatcgtcgctgactgcgcaaatccacggataatggataatatatggttctgatataccagacattccgggctccagatgtatagggggatctttgttggcgaaaatttcgtcaacaaacatggtgcaccaacaggtataagtgttgcttatttatttcaggctcatcgaaccagacataacaaaaattaataggggctcattcatcgatcaaagagagatctcagcaaacataaataaatgcaaaataatgaaatgcaatctttgttattacatttggtctaaccatggagcatgggaacgaacgcaagaaggggtgagtattgaggtccctgccaacagattcggacattcccatgatatgtttcgtgagtataacagccgaatgagttgtaacatttcagagagtgaaattattagaattaaaaataaaatgactatccatgcctaaattacccattgtgagtggaaatggaggcggttactgcatttaccaaattgggctcgctgatttcacgccagcgtggcagtcatgctactaacaaaagatggatctatctataccttgtctgtccctcttcaccaagcgttaggacccggccttttacgagatctgattcggatcgctgatatcaccgttgatgaatttgcaccggtattgtaagttcattatacacccttacacgtttgagtgcacaaaatgaacaccgtcataaagagatgacctttaaacaactcataacttgttcagattattcgattatttttgcgattatgcacattaaaagaggattattttatacgcattttttattcacaggtaagacaccagacctcttcattccatccgacaagccggatgatgttcagacacatatcccggatctgatacctgccaaaccgcgatttataggagtaggatccaactctcgacttataccgtgatggatcgtcggaaaaatacccggagtactccctcactatccggtcaaacttctgcggctctttctcaaagacaacctgtaccgtatgttccagaacctggtaccagtacttcacctcatgagatgaaccggcaatagtgagcatcgtcggccgtgccatctttggtatctcaccctgccgcatacaggcactaggagcaggtgagagttttgggacctcggtttcagatgcctcacaccgtgcccatatcttcacgcagaatgccgccagaacgcctgaacgctgatcgatctggtatcgtctccagaaccgtatatttttcatacctgcattcagcatcaggttatcaagagcataccaggcctttttcacctcgaaatctgcattttttatcgccgggttctcctgggtaatcgtcagatttccaagccggtgcacaaagtcggcatggactgaagaccagtctgacccaagatgctctttccagttatctgacagtgtttcaggcatgatatgatcgatcatcctgacttcagcctcatcctcaaacaacgcatatgatggcgcaggatcagagccccgtggctgactagaaaagtactcctcaagccgctctaggatgacaaatgcaagtttattgtcagaacccggctgatagagatcgctgtaccggagatgatccaagaactcatcatcatccggcatatcaaaaggagcctgaagagatgcgataaatgacctggtctcctccggcgtaagataccctaacccgtctgatgcaccccggcagaggatctcaaacacttcctcatataccgcatctgacctctggcagaccatccgacgtatcaggtaactttcaacacaggagaggatttcaagtaattcatcatctgatagtgaagcagcaggatttcttcgtcgatcatttgctgccagcagaagaaggaggaatggtgcaggggcattattgccgattcgtttaattcgggtaagggatttacacacctccttcctgacccggctgtccccgtcaccctgttccggaaagaggataaggcggtaatattcagaaaatctgctgatatcccgaagtaacaggcgaacatcatctgatgaggcctgctggtatcgcctccggatcttctcaaagatctcgccatgacggataatacgaccgtccttcatgcaaaagtgccggataaaggaggatatcagaacctgatcattattcagccgctcttccatcggtttccagaactgatcatactgagcttcggcaatctcctggctgtccagatgggcgaagaagaagttcctgataaggtctgactcctcaagcggcacaccccggtaatttaaagcctcaaacacctggttcggattttcaccctcatcaagctctatataaaccacacagagatcttcagtaattacttcctgcaagagatgcagatccatcccggaaaaacggtcgagttgccaccaataatagtcaaaacactcaactatccctgaatcctggtcaaaaacatagtcttcatcaaaaatatgaaacagggcgtttttatcgacccttgtcgggatgacaacatactgcccttccccactctttggtgcgttctttaaaaaatcagatatctgatcatagagctcatgcagccctttctcccgtgcaaatgctctgataacggcaagaatgatacttacggtggtgattcgctgctgaccgtctatgatgacatatttatcaaggtttttttcatactccctgactacaacgatggaacccaggaaccgggcaggcgatttctccgatccagtacgaagagaatattgttccctgatatccgcccataactgctcccactgctgtcgtgaccatacgtacgggcgctgaaacagcgggaccttgtattgttttgccccgttaaataagtcccagaccgatgccttggtcgctttcattcaccactatcccggtagaacatatcgcgttcctatcgctttacctcaccggtttgttaagaggagaattacgagcgttccctagcaggaaatgataaaaaaataaaaatgattaccaggcctctgaaaaggcactgttggtgtatatgtcttctaggcgggctttgtgtccgcgctccatctttgccagctcttcaaacgtcttcttctgatctgcatccgtacttgcagcggcaaactgctcgtacatctgcattgcttcttcttcccgcttgattgcaacctgaagaccttcaaggggttttaagtccattgatggttttggcttttcgatggtgtctgaaatatggtaatccttaacctcatcaaatttgagctcttttttggctccacttaaatattcctggagagttttccggtgatatgtctcctcctgagcaagttctttgaacgttcccttcaaagccggatctttaactttttctgaaagtgatatgtaaaaagcatacgcatcaacttccttatcgatcgctgcaagtaaaatcttcttatattcttccagtttcataaatcaccctcctgagggtaagtaataattctggtgaattggttaaaaaagatattgatcagaagagttctgccagtttaaactggaatggcccaagctttccttcatagttaccggcactgatgaacgaaacacccggaaccttgactgcagccttgatacctgctgccattgcctttttgactgatgcctcatccacaccattgatgacgatctcatagatggatttgacaccatcagggactttggtatccggaaccttctcacggatggtcgggcaatactgctcattggtcgttgccggaattgggaacttgtagttctttgatccgactttggatcctgacgcaacaataccgcctgcgaagctggtgatggtcccttttacttcaaaaattgcatctgcagctgcctttgctcccataagggcagtcatctggttgtctgccatgacaaagaagttcccgcctgcgacacccttgaccatgccaaagacttcttctccaacatagtctccttccataatcgggatcttccagcactgccgtccgccaatctccaccttggattcgaacttgtctccaaagaagtgaattttgatatcgaacttctcttctgcatcaggcatgccattaaagacagaggttgttgctgcggtcaagacgcactcggcaatacgctccatgacctgttccggaactttcttctttgaggcacagatcagaatggatacacccggacgtccgtcaggggtctcatctgcactgacatatccttcaatacctgcctcacagggacaaccaattgcagaggttgcaaacccggtagcctccatcgcagcggtcattgcccattcgcgggttactccggttattattacccgtgatacccatattggaaatccttcagcaaatgtgttatcaattggtacaccgttcagttccattacggttcctcacaaagaggtcatctgtcagaccaataatggttgtgaattcgatctgataccaggtgaccttcggacaggtatcctgcatctattctgcaggcacgaagcacatcacatccccgtatcggctgcgacggatctgccgttgttacaagggttgacaaggccagcacggaatcaggaagcttcatcccaaacagatcggttgaccggacttcatgggaatgagtctgcaccgtcttcctgaccgtccccctgtttatgactatccccatccggttcataagagctgccgcatgggaaaaggtgtggtcctccgagagagagaggcagagatccacaatcggtgatccaaacctgcttttttcataaaagggcgctttggcatagcagagctgaccacagtcccgacaatgaaagcgcttgacatacacatagatgtgcatctccccttcaggagcatacaccgtcgaaaatcgccgttgtttcatatcatggctgatcaccatgcccatgcagttcggacagggaagggggtcggtaaactggacccccgaaactcctgttaccgcctgatagaccaggtcagcaataatcggggagataaacggttggcgacgcatctacaggatagtataatcaacctgtccggtttttaagcatgacgcattgcatccggtgttccaaacctggtgaggagtcgccagaggagtattgtcagcgtacatgagtataggacctgcagaaagatggtccatggaatttccatgctgaaaaagatgattaatgcgtaaactggagtcataatagagacaatatcctttttttcaaacagaagcgcaagagcagccaacacgcatgaaccaagaacgcaaccccagataaagctcccttcattttcaattatacccatggaatgcaggagaaatgaaaaaccaattcctgcccatggaatgacaagtgacaggacgcataaaaccttttggagcacggtcaggttccggataggaaaaatatcggcgatattcatcatccttatcctgtgacggactggatgatgaattgtccggattatgatcgcagaggccatccgtcaatcaccgatgagggtgtcacatctggtacgatagatataaaattccttttgcttggacattttttagaaaattgaacagttcagttcgggattattttcaaaagtgtttaatactatcacaaaatacttaatgtttaagcctgcaaggcgtgttgtgtggccttgaatcaggcagactctgtgaaggtgtaactaactatggtatttcatccacccgtacaaataatcgccaagggagcgggcgctggaaagtataaagcaggcctggaatggtggaacatgatcatccgtggattcatgtccggggcatatatcgcaatgggaggtgccctcgccaccgtctgttctactgcagtcgcagataacctgggagctgggtttggtcagctcattctgggagcggtgttccctgttgggcttattatcaccgtccttaccggtgcagagctctttaccggtgacgcaatgcttgcacctctcgcagcattcgtccacaagatcagctgggcaaaagtcctgaacctctggatctgggtatatatcggaaatcttatcggttcgatcttttatgcatacatcatggcaaacggaccgtttgtctcctggaatgccgcaggacttgcaaccgtgaacgcctttggattacgggcagtaaatatcggtattgcaaaggtcagttatgttggaatggcaggcatctgggctgcattcctgaagggtatcggatgtaactggcttgttaacctcgctatcctgctcggtatctgtgcagatgatgcagttggtaaattctttggaatctggttcccgatcatggctttcgtctcaaccggatttgaacactgtgttgccaacatgtatttcatcccagccggtatcatgacggcagggtacctgaacgcagaacaggtcgcaaccattactgcagagaaacttgcgacactgaactgggttacgatgtggacaaacaacattatcgttgtcaccattggaaacatcgtcggcggtctgatctttgttggtgttctctactggatcgccttcaagaaagagatcgaagcacttgagtaattacacacccttctttttttatgcagtttcttccaagaaagatacgaccgtcaatcctgcacgtccttgtcttcgcattttttctgatcctgatttcgatctatgtattctccactggagataccagtatgctcatctggggaattccgactttaatttgtcttcttcttattcccatgggtctgacctacctctcacaaagtcagtattcggacctcataccaatgtatgaggcatctgcgaaggacgtaaagatccgtgagatcaacgaatccatggtatccaaacccatcaaaatcgagggacttgtagaagaagtcagattcagatcattaaaccggccgcatttcatcatcggtgaccggaccggtgttaccacggtaaagatgtttaccagcccccggaatgacatcaataaaggagacattgttgaggtgtacggacaggtcatcagaagatacatcttctatggtgatccgatcgtcaatggtgtggacatccgggtgaccggatcccgtgagaagagttcatcatcctctgctgataaaagcagaaagaaaaagtgaacctttcagtgcgccctgttttttccattctctgaaccatttttcttcatcgttgacaaacacaggtaattagcaggacttgttttaccgatcaggtccggttttcccggcaccagaacttcttgtggaagtgtcccacttctaatcaccaaaaatgagaattttttcacaagacttaatagtcccaatccagaaccttttgttaccgaggaatcgtaatggatctcaagtatgtccagactacatgcccgtactgcggtaccgggtgttctttaaacctcgtggtaaaggacggaaaggttgtaggtactgctccctaccaccgctctccggtgaatgaaggaaagctctgcccgaaagggacctatgcgcatgaattcatcaactccccggaccgactaacaaaaccactgattaagaaggatggaaagtttgtagaagcaacctgggatgaggcactcaaactcattgcagagaagttcaaatcctacaaacctgatgaatgtgcctgtcttgcatcagcacgtgtctccaacgaagacaactacgccatgatgaagtttgcccgtggtgtcctcaagaccaagcacattgatcactgtgcccgtctctgccatgcatctacggtagccggtcttgcaaacatctttggatctggtgcaatgaccaactccatcggtgatatcgccgattcaaagtgcgtcttcatcatcggttcaaacacctttgaatgccacccgcttatcggacgccgtgtcatgcaggcaaaggcaaaaggtgccaaattcatctatgccgacccgcgtctgaccgcaaccggaaagcaggcagacctgtacctgcagttcagatccggtaccgatgttgcgctcttcaatggaatgatgcaggaaatcatcaaaaacggatgggaagcaaaggacttcattgaaaaacgctgcaacggctttgatgaactcaagaaagaggtcatgaaggacgagtacagccttgagaatgtatcatctatcaccggtgttccggtagatcagattaagactgcagcagaatgggttgcaaaatccggagcaactgcaatcctctactccatgggtatcacccagcacaccaccggagttgacaacgttaagtctgtaggtaacctgcagatgctgaccggaaacctcggccggccgggaactggtgtgaacgcccttcgtggacagaacaatgtgcagggtgcctgtgacatgggatgtctgccggttgtctacaccgcataccagaaggtcattgatgaggcagcccagaagaagttcgcagatgcatggaaattccctgatggcattgcaaaaggtgagaacgggtacgaagtcaccactcttatgaacgttctgaccgaaaagccaggtgagatcaagtgtctctacatcatgggtgagaacccgatgatatcagaccctgacctgacccacgtcgagcatgcactcaagacccttgatttcctggttgtccaggatatcttcctgaacgagactgctgagttcgcagatgtcgttcttccggcagcctgttatgcagagaaggacggaacccagacctccaccgaacgccgtgtccagatgtggagaaaggcacaggacccgccaggagaggcaaaaggtgactgggagatcatcgcatccatcgcagcagcaatgggatatggagcccagttcccatggaagacctcagaagaagtcttcaacgagatggcatcactcaccccgtcctacgcaggaatgacttacgagcgtctgaatcggcctgaagcactccactggccctgcccgaccaaggaacaccccggaacaccgattctccatagcgagaagtttggtatgcccgacggcaagggtctcatgaccgcaattccgttcaagtggccggtagaagttccggacgaagagtacccgtatgttctgaccaccggacgttccatctggcagtggcacaccggaaccatgacccgcaggtctgttgaccttgagcgtgaagagccaaccggatggattgagatcaacaccggtgacgcacagaaacttggcatcaaggacaaggaactggtcaaggcaaagacccgccgtggtgagatcaccatcactgcacgtgtcaccgacaatatcaagccaggtgtcatgttcattccattccactacgtcgaatgtgccgcaaacatgctgaccatcaatgcgcttgacccaatcgcaaagattccggagtccaaggcttgtgcggttcgcgttgagaagatacaggaggcctgaacatggcagcaaaaggcgatatgagctatgtctgggcaaaagacaaagagatcctcgagaagggagaatgcggtggagcagtcactgcacttctcaaatatgcactggaaagtaaatttgtagacgcggtcctcgccgtcagaaaaggccaggatatctatgatgcagttccggcattcatcaccgatccggcagaagtagcatccaccgcaggatccctgcactgtggaaccctcctgcttccaaagatcttaaagaactacgccgacggtgcaaagggcatgaagatcgccgtaacctgcaagggttgtgacatcatggccttttacgaacttgcaaagagaaaccaggtgaaccttgacaatatcgtcatgattggtgtcaactgtggtggatcggtaagcccggttggtgcacggaagatgatcgctgagaagttcggcgttgatcctgacaccgttcacaaggaagagatcgacaagggtcagttcatcatcgagtacgaaggcggacacaagggcatcaagattgatgaacttgaagaagaagggttcggacgccggtccaactgccgccgctgtaagatgaaaatcccccgccaggcagatcttgcatgcggtaactggggagtcatcggtgacaaggcaggaaaggcaacctttatcgaagtctgttcagagaagggtgcaaagctcctctccgatgcacaggcaaagggtgttgtcgaagttgctgcagctgatccaaagggtatcgagatccgtggcaaggttgagaaggccatgctcaaactcggtgacgagtggcgtgagaaagactttgcatcacttggcaaaggcaaagaccgcttaaaactcctgatggaggagacatcaaagtgtatcaagtgttacgcctgtgtcgagaactgtccaatctgttactgtgttgagtgttcaaccaagaagccctggtacatcaccccgggacagctcccgccaggctttatgttccatctgatcaggtttgcacacatctctgactcctgtatcaactgtggtcagtgtgaggaactctgttcgatggatatccggaatgcactcttcatgcactcccagcaggttgagattgagaagcagttcaagcacacgccgggtattgacatgactccgccaatccacgcatttgttgaggagaaggcagagcgggcacggcttgatgcaaccggaaccgattccatctatatcaacatattcaaggatgagtaatcatccccacatttttcgcaaaaccagccttttttccctaccggggtaacacccggacagggaacaccttaagatgttcacagacatcctgtacgtatgaatgagtacctgcgcaagacatcccatctgttattcggactccttgttgccggtgtaatccttatattcccgacatatcatgccgccatgatcatcggattttccctgtacatcggtcttatcctcattgacctgtgcatgaaaggatataccatcccgcttatcagcacactcattcaccatatggagcgtgaaggagagtttccagggaagggtgcattcttctttgtattcagcgccctcgtaaccctgatgttcttcccaccggttgtcgctgctgtatcggttgcagtccttgccgtgctggatggattttcaacaatctttggcatccgatttggaacgcaccggatatggaagaaaaagacccttgaagggttcctcggaggtgtcattatcacgacggctctgctcctgcttatatcacccccgatgtatgccgtgctcatctcacttgttgccggatttgtcgaactcgtaagtccggtcgatgacaacctcatcattccgtgggttgttgcgatgctgattaccctactctgaaaaagaacacatttcggtatatttttccgcgacatgccagagcatgtttaaagaggcgagataatatcgggtatagacacaggtttttcggagcaaaaccattatgcttatatccccatgacacgcagaatatgcgatggaaataccttctttttcagacctccagctttcacctggaatcattaaagccatccgtgatatcggatatgaagaaccaaccccaatacagcaagaggttatcccattaattctcgccggcaatgatgtagcaggacaggcatacaccggaaccggtaagactgccgcgtttggtatccctgcaatcgaactctgtcagcctgcaaaccggaacgttcagactattgtactctgtccaagcagagaactggcggtgcaggtaggaacagaactcaataaactcgcaatgcataaaaaagggatatctatcctgccggtatatggaggccagcctattgaacgacagattaaagccttgtcgagaggtgtccagataatcattggaacaccggggcgggttattgatcatatcaaaagaaagacactccttcttgatgcggtctcccttgttgtccttgatgaggcagaccaaatgttggacatgggttttcgcgaagatatcgaagagattttgtcccatataccaaaagaacgacagaccgttatcctctctgcaaccttccctcctgaaatccttgatatctcccgacgtttccagaaaaaccccatcgatgtcaagatggtgcaccaggaactgacggtcccgcagattgaacaatactatatcgaagtcagagaaccggcaaaagcagatacgctcatcagagttcttgaattttaccaaccccagcggaccatcatcttttgtaatacccagatcgccgttgacgccgtatccagcgccctcaaggcagaagggttcctcgccgacggactgcatggcggtatggcacaggcccagcgtgacaaagtcatgaatgcattcagaaaggggcaacttgagattctgatcgctaccgatgttgctgcccgtgggattgatgttgaagagatagaccttgtctgtaactttgacttcccccaggatgatgagtactatgtacaccggatagggagaacggcacgggcaggacgtaccggtcgtgccatcagctttgtcagcccccgtgagcggtacagacttcgggatgtcagacggagtacccgtgcagagcctgagccactccctattccgacccttcgtgagataggcgggaagaaggcaacgactacccttgccgatgccgatgccctgatgaagaccggagacctcacattctgccggccgatgatagaagagaaacttgccgaaggagccgaccccgtggcacttgcaacctctcttctgatgattgcagcaggcattgcaaccgaaaaagaggatgatcttgagaagtacctgggagaacaggcagtcgtcagactttctgcaggaaggcaggacggcattctggtcagggatattctgcagattgtaagaaacagtggcagaaacatccagaatgacattggaaatatcaggattggtcagactgccacctatattgatgtccccgaacaatcggtgaaggaagtcattgatgtcctgaacggtgcacagatagggagaatcagacttgtggcaaaaagagggagaaagcaatctgaaatcccgaagagacgctttaataaatgaattaaatttttttgaatgtgaaaataaaaaaataaattatctttttttcgccacattcatcaacgtcaggagtccttccaggatggctgccggtgtcggaggatttcccgggatcttcaggtcaaccgggatcacggcatccaccggaccgacgacggcataggttccaatatacatgccgccggtacaggcatcatcaccgactgcaatgacaaattttggttctggagttgcttcgtaggtctttatcagtgcctccttcatcccatgagtcaccacaccggtgacggcaaggatgtccgcatgccggggcgaggctacaaaggttatcccaaaccgttcgacatcatagtgtggagcggagaggtttgcaagttcaatctctgcagcattatcactgccacagtcaacctctctgatcgcgatactatgcccgaacacccggtcaatctccgctttgagcatcactccggctgattcaaaagcactgtccggggtgtatgcctggagatcctttggttttttgagtaaaaatgagagaatattcatattcatcctcacagatcggtccctgcatacgagaggttcatactcttatttataaccgggaaatcagggacgatatttcccagaacggcatgctcgagtgccatccagttacagaacgacgcggtggacagggcaaaccggtcaatagagccatcacatatcctgacataacagagatttcgtcctcggggggattcaacggctgcaagggcatctccatcacagacctcatactctgcctgaaccggcccttttggtatctgcctgacgagttcggtgatgtacgcaagggatgccaggacctcatcacccttcagggcaaaccgtcccaggacatcaccggtcatccgggtgagcggaggaatgggatgagtttcgtacaggccatagggatgatctgacctgacatcaagtgcccggccgctcgcccgtgccaccggcccggatagtgccagaggatcgatgagtggctcccgcaccaccccggttgtggagaaccggtcaataacagacgggacagagaggacccaggacaggatgccctcaagatcgaccctgaccttcatgagcgtatccgtcacctcaaccagcagatcatcggggatgtcatggctgataccgccgataccgataatccctttcaggaaccgtgaaccggtcaggcgttcacaaacccgctgcaccgtctcgcggagaatgagaagccggcttgctgccgtggaaaacgcaacatcggtgaccataccggccagatctgagagcagtgaccaggatcgttcaagctcgaggaaatacgcccggagccagactgcacggggcgggacctgtactgataagatctgttcaactgccatcgcatagcagcaggcattggcaaccgactcatctccgctcactgactctgcaatcctcacccctttttcaggactgcacccctcagcacgtttctcaataccccggtgcaggtatccaagacgaatctcaaggtttaaaatgtcctcccctatcaccgagaaccggaaatgccctggctcgatgatccctgcatggaccggtccgaccggaacctgatacacccctgtcccttccatggtcctgaattcatagggagtcgtatggtccgacgccgtgaagggggtgatgggggcattcttgatactcttttttaatggataaaacccgtcaggatatgcttcatgaaggaagagtctgcgggtatcaggagagccggcaaactgaagaccaaatccatcagtgatcgcccgttcaaacctgctcgcagcaggatagatctccacaagtgactctggcattcgggtattgaggaccaggacaagatatttcctcatctctgtgagctcaaagacataccttagcacaaaggaaccatctttcgcttctctttcgcagaatatccagaccaaacgggactcaagagccagaagtgtctctgcaaccgctctgatacgctcatcaggcactgcataggagatggttgtcatatcttcccctatcagccattcggccgggagggagagggctgaataatgtgcatgtacaccggtcatagctgcaccccgaatcccagatcagcaaccgccgcagcaaggaaggcttcctccccaggtatcatcacggtcccaatcatgattgaaaggaggagaagcagaacaatgggaactttcatggagagaggcgccgtatagggcaccggaccttccccggccgggaacctgaccgccattaccgggaggtaaaaccggagcagggcgactcctgcacaggcaaacaggagaaggactattgccggaatccatactgagatcgctgcagctgccagaagtatccccacctttgagagaaagagcgggaagagaggcattccgataagagctgcacaccctgccatcacggttaccgccgcaaagggctgaagcagcaggaggtctccgatctcgtcctcaccggtccgtgtcggaaccttatactggcggtggaggataccggcggagaagaacagacctgctttgatgcaggaatgcgagagcatatgaaagagtgcccagaatagtgccaccgggcttccgataccaatgccaagcaagatgaaccccatattctcaatggatgagaaggcgataagcgtcttaagcttcttctgcctgagcatcgagagacaggcgaccgagatagtaatcatggcaaagacgatcaggagaactgatacctgcccgaacacccctgtctccttcatgatcccggtcatccggaggattccatacatcccgatattgagtattgcaccggacagaaccgcacttaccgctgaaggagccttggcatgagccagaggaagccaggtatgaaatggcacaatgcctgattttgctgcaaacccgataaagaagaagacaaaggcgataaagaccatgccgctgtccagaccggctgcttcatccacaatctctgtccacagaagacttccgacaccggtcttattcctgaccgcctcaaagaggaagatgatcccgatgaatgagaagagcatcgaggttgaacagatgaagatgtacttcagcgatgcatcaatcgttgccttgagtgcaaggattgcaataagcaccgcagagagaacggtcgtcagttctgcacagatccagaacagggcaatattgggggtgaagattgccatggttgtagcggcaagcaggaatgagaatccgaaataaaatatccgaagacttctcttctccagatcccctgacctgaccagcccgtcaatatatccaacagcatacagagctgctgcagcaaagatgatgctggttgtgagcatcacaaaaaggctcatgtgatcgatgaggaagaacggggaatcgtcccagatcccaggagatacgataaaatacagcgttattatgagggaaataaccggatggataacgccaagaaggctgagtgaccggtgtgtccggagcagcagctgcaaaagaagaatcaccattgcaaccaccgggtacaggactgctatcatgctatccctccctcttcagacagcagatgaaactcctccaaccggcttttatactcctcaatggatgagtctatgccgacggtcatgatggatgtcaggagcaccaggatgatgagatcgatgacgatgacaaactcgatgaagaacggcagttcagtgacgaataatccaaaggcaagaaccccattctccatcgacagatagccgatgaccttggatatcgccatcctccgaatacacaccgctaaaagtcccattaggacgagggataccccgatgaccgagcctaagaagaacaagctgcttgccgcatacagtgactccagtatctgtgcaaaacagacatagacgagcagaataatgaggatgctgagcataagggcaccaggaggccgaagataggagaatttcagatcctgctgaatatgtatccgctcctgaatgagcctgatacatgccggaatcccccataccttggataccactgtgagggcagcgaccaggaggaggatggtatgttcttcaagtacgacaaggccaagcgcaatcagaaccagcagaaaagactggaactgatatgtcctgaccagatttttaagacttcttgatgagaggagaaatcccccggacaccaggaccagtatcagacatatcctgatccacaccggtgccacttctgtaagtatcacagcatcacctcgatgaatatcgtaagaattgaaaagaaaaatgcaatcataaagagattcggtatctggaagaaccgcatcttagcatatgcagattcaaaaagcccgatgatgacacagagcactgtccctttcaggaggaacaaaactcccccgagtatcaggactccggctgacatctcaagagcaatccctgccgggagtatgatattgaggagaattgccataagaagggtctgttttaccgcatgtgagagttcaaagagggcaagatttcggcctgatgtgtcaagcagcatcccctcatgaaccatggtaagctccagatgagtctccgggttgtccaccggaacccgccctgtttcaacaattatcaggataaagagcggtacagagaggagaagaaccgtcggattgtatgcagggaacatcgttgtggccgttctgaatatgtcgtgaattgaaaaactgcccgttacgtataccagggctgcaaagacgaccacggtcaccggttcgatgatggcagacaggctcatctcccgtgaactgcccattccaccaaaagtgcttgctgcatccagaccaagcagggctatgagcagccggccagtgacgagaagatagaggaatacgatgatattggcagtgaccagctcctgttcaggtatccagaagatagggaccatgacggctgcaaccagaagtattgacagagcagcatacggagcaatccgggagataaaccctgcatactctgaatacagcgtctcttttctgaagagctttgcaagattatagtacccttgcagaagatgcgggccttgtctgccctgcacccgtgcctttaccttttttatgaccatcatgaaaaatggcgatatcacaaggacaaaagccacattcaggaaagcaaagatgaatgattctccaatcatgccgaccacccgaggatgagaatcagtataagaacggtgcagaagacatagaggacataccggtcaatatccccattctgaagagatgagacgagggatgcataccggtcgattctccgtgctgccggaaggtacagatattcctcaaaaaatttcatgagatggatactaccggttcctgatctgaacagacactggtgctggtccagaaattcatgggttgtgcatatccgggtccggtacaccgggccaaaaaacctgaccaccggctcggtaaatcctgaaccggtatactccatcctgctcgaagagcccatcatcccacagtcccatgtccgggttatccgggtttttcgtgaggcatacgaccagaccgctccatacaccaggatactggtcccgaggaggagcagaaaaagtcccagaaggtcaggaagcaggccgggatgccccagaagagagaagacctgaccggagaagataccaagaccggcactcatgagagccagaacagccggtcctgcatacatcggccaggggacttcccgtgctttatctgctccctccgacctggggagtgcaagaaaggtcagcccgaatgcctttacaaaggttgtaacggtcagtgccccggtcaggctgaagagggagagcacaaccaccatgacgatctgcaaaagcggggagagttctgacagaccaccgataagggacataattatcagaaactcaccgataaacccgctaaagggtgggattgatgcaatggacaggacaccgatgaaaaaaagtccgccggtccagggcatcctgacaaggatcccccccatctcatcaatattcctggtaccggcagcctggcagaccgaccctgcggtcaggaataacagccccttgaacagcccatgactgatggcatgaaacacagcccctgcgatcgccatcaaagcaagggtctgggatccgaataccgtgaaaagaacccacagaccgatcccgatcagtatgatacccgtattgtcaatggatgagtaggcgagcagacccttgagatcctgttccttcagggcatacatcaccccaagcacagccgtcagacacccgaatgccaggataagaaacccccatgccgcgtcgggagcatagaatccggtaaccacccggatcagggcatatagagctgtgcttatcatcatcccggacatcagggccgataccggcgatggtgcagcgggatgggcatggggaagccatttatgaaacggaatgacccctgatttgatagcaataccaaaaaacaggcagaggaacgagagggatatgagaggatcggatccggacagatgaaccggatactcccatgacccggtcccaaggcgaatcagtagaattcccagaaaaacaaagactgttgagatctgagtcattgccagataaaagagggcagcataccgtgttttctcctcctcgaactccgtcaggaccaaaaagaaggagaggatagccatgagttcccagaatacaaggaatgcaatgacagtctctgccatgatgacgagcagcatactcaacaaaaacaaggggatgagccctgacaccacataagttcgccggtttccatgcatccggtcaagatatccgggtgtatagagggcaaccgcaagactcagcaacccaagcaggatacaaaacagagcagacaggcgatcgataccgatgcgtatcggaaatgtcacccatgcaccctgaaagagaatggtctttgcagatgatacaagaagaaagggaagtgagaagagcgtcagcagaataccaccaccgcccatgattatcgaagaaacagaccatattcgtttttttcgaatgcacagaggaattacccctgaaagagcatagaggagtatgatgaaaagaaatatttcagacataaaaccacgtcgggggttcgttctatagagcagatttaagaataaattcagggacgatgcgtgtgatcgaaccggaattacagattagaaggaaatagacgataaaggtttcctgcctatcaggacatcagagagccaacctaaagaaagtatatatgcagatgaattcaattgttaagggcatgaaaaaattaattatctccggtccacgcacatgccggaaatttaccacggtttctaatgaaatcgcgaaatatatcaaagaaatcaatggtgttgatgagattatcaccggcggttctactggtgtcgacctcatcgcaaaggagtttgcagaacagaataaaatcgcgtacaaagagttttcaccgaattggcaggacgatttgaatgctgcaggtctggtcagagacgcgcgaatggcagagtacgggactcatctcctggttctctccaacggagcctcaaaagagtccagaaacctgattgcagaagcaaaaaagaataacctcaccattaagaccatcggatacgtagaagagatgctcatcgagatgaaacagccggccatgactccgaccggaaccatctaacctttttcaataccagatatcaatatacaaaaaagttcgggtataaacccgtaatacatttctgtctattctaccttcaaaggtcggccaggatcgacaacctcaagctgtgcggttgacatccggtaatagagtccgaccaccctgagctttcctgcatcttcggcgtccttgaccacgctgtaggtgcggagatgtgcaagctggagtttcacattctcaatctctagttctgactgccatttcctggcctcttcaggatcggttggtttttctcccttcttttcaacggtatccagagccgtatgagcatgtctgagccatcctgggatcagaacatcatcaccgctcttcttactggcaagtgctttcatggcaccacactcttcatgaccgcacacaaccagcgtgtttatcttcagatggcgaatcccgtactccagaaatgtcccgacattccagtctccgggggggacgatattcccaatgttccggtggacaaagatctctcctggctttgcatgacaagtgatctctggtgcgactctagagtcacagcacccgatcatcatgacatgcgggttctgccccttgagaagggctttgtaatactcaatattctctgcgtattcattctctacgaaggtctgattcccttccattaacttttcaattcccatgttatctcccagggtccttatcacataaggattacagatcgtgaactgaagagccaatatacattacgatttaatccggagaccgggtgataaaccgaaagattgaaaaaggttattacctgattaaaccacatggaggaagcaaccctgcaggcagtgaaacgggcaatgcccggtcacggaagagcccgcattcatgaaaaactcctttcattcctcggtgtcgaggatcagtcagaggtggaagtgagcacagatgcaggggcaacccttactctgaccatctttgcagatgccatggtagacgagggaacgatacgaatcagcggagaggatctgaaaaagctcaatattccggatggcgggaaggtccatgtaaccaggaagattccgcttgaggagagaattcggactgccgctgaatccgctgccgggcagatacggggaggagcacaggagatcggatcaaaactctctgaaactgcagacaaattacagaagggagcagcagataccgcaggacagatcagcacaaaagcaaaggaaataactgaaaaggtgaaagaggacacaaaacccatcggagaaaaagtcagcaaagcagcaaagagttcggcagaagccatcagggacaagatacccatcggaaaactcagcccggagattgagaagggattatctgccataagtcaggaggaggcaaaggcgatcagaagtgccctgaccggcatagagggcgtcagcgcggcagtcccggtacggtttgcagcaggccgatcccttggcaacctcacaataccgccggaaattacactcgtaaccgtccagcggaaagataaggtcctgggacttgacagagacatcatcctaaaagagaatgatatcgtatatttctccggaccttctgacgccgtcggatttgttaccagaatgctggagggataagcttggagatctccttttcccaggatggtcttataggaattgcagtccttcttgtcatcgttatcatgatatacctgatcatcagggagatcagactgatgcggaccaataccaggaaactggagctggaactggaacgcgataagctccagatattaaaacaggataccgcagcttcagtccagccggccttacgactgacaacagatcagatatcagcactcaaagagattgaagaatcgaacatcgcccttgaaaccgagatcttcatgaaacagaagactatcgagggcagactcaagcgtcttgaaaattatgtcaagcgtgaaaaacttgacctgatgctggaccggattgattcagaggaaaaaaagatttaggtgagaggaatgtttgaaacatctgggagcacacgaaaattctttgataacctgagcagttttgaaacacgagccacatctcaggtccctacctttgaccggacactggactcctactttgatcggaattttgaagccattgttgaagaatgggggcttatcaccgaggcagacctgcatgaatatgcacggcggcttgaatttctcagctatgaggtcggacgactctatgccatgaaagatttattcaaaagccgggcagattccattgaaaaggccatagaggaactggaggcgaagaaatgagcatggataagtacctgaacgcctatctcgaccggcggatgaaactcatcattgaggactggcagcttgcaactaccgctgatatcagggaactatcacaacggttcagacaggtcaaacaagaggcagagagtctgaaatcgtttgaacgtgaatcaaaggatcggatggatcggatggaagagcggatacggaccctcaggagccggatgaaatgacactcattgagatactcctgatcatcctcatcgttctcatcatcctcttcctgctgttctggttcttccagggaaccaccggaagaatatctcttcgcagaccggttgaaagcagggtggatgagtacctggaccggcggtttgcccagcttgttgaagactatggtgttatccgcagacctaaactgaaccggttcaaggaagaacggggatctgctcttgagaatgatgcacaaaagatcgccgagctgaaacagtttgaaagtgagttctcacaaaacctctctctgcttgaggcacgacttgatgcactggaaagatcatttgattcgaagaagtaaggacactcaatcatcagggggcatgtttcaggctcttaaaaaccaggtaccccgggtacgaaaagaaaatgaacccccgacccgggatcccgaatccttttcacggtatgtctgtgatctctgtcacagctccggctctctgtcaggacttcgtcagtgtgttatctgtggcagatggggatgcagttcctgttggcaggatgagtattacctctgtaaatcatgtggcgggatcatgaacctgctcctccttgagctgccggtccgcgatactccggatgaaccagatatcaaaaccgaaaagcgggatgaactgaccgaagacaccccctgatcttttcttgcatagaactggatagttcaatagttccctgaccagatgatataggagatacctccggaaggcctgtcgtgaaaagtataaagataccatcccttatctcatcggtcgtccagaatgcattatccggactggaagggatggagtttaccctccttgaccggtgtcctcactgcggaggggaggtcaggtaccacgacaaccggaagaaacggtttgcaaccatactcattgatgatgagaagcagataatcaatgtcatcgtcaccaggtattactgtaaatcatgcggacggctctgttatgcactggccccgttttatccgaataccaagtttggatccccggtcatcgatctctgcatgacggtggcacggatccatccttataaccatagtgcacgaatccttcaggagatgggagttgtcgttgaccgggggaccatccggaatttcttctcccgtgatatcccggcggtcagttatgcaaaaatatacggcctgccaataccgctctccatatttcacctgtcagatctctcttccagacgcaggcagtctcgacaggtcaccgaggaggatgtcctcagggcctgcggattcccatccacaaaagatctctttcacaagacgccctgattatcccccgattcatctgccgcaggaaccttctgactgaacagacgaatcatctcctggtaattattcccatagtaatgttcccattcttcatgctgattcacctttgcaaggatgggttttccttcaggcctgccaggatgatatccgaacatctgctcaagttctgcctgcagggcatgcatcatcagtgagaccggaatatccatggcacaccggtcctgacactgtccacaattcacacaggagtcggcgatatgggagaaccggatcagatgaaacatcaacggaggcgggacttcaccaggcctgaccagccagggtttttttgtctgacaatcctgacagaaacagaacggacaggccttcgaacactggtaacatttaatgcaccggtttgtctcttccatgatccaggtcagccgcccgataccggtcccgacttttgcaaacatcgctttgcggttcttctctgatatcgtcagcatcgctgcctcaacacgggatcgtgcctcaatacccttcaggtcagcagggactatggtcacaaatccgtcttttcttgcctgatccagaaatgccagcccttttttactgcacacctcaataaaggttgcctgatcggagtattcacctaacagcccccaggttccacagacaacgtcacattggcggggaatcggggtatcacatctcctgcatgaatcacgtctgccaaacccgtgctcctcaattatctccaaaggaaattcatggactacgtcaccagacctgataactacccggccattcctgacacaaaaagaatcaacatggtccggattcagatcacagacctccctgataaatgccctggtttgtatgggggaaaatgtcccgctgcaattgagtccgataagatagagatcgtcccggtcaagtatattccgcttgaccagttccacgatgacctttgcatcacaccccttgacaaccgcagcaatcttcatcccaggggttgcctgcacggcactgacaacccagtctgcggtcagaatactcccacagaacaaagatccggaacatgcagggatcttttccggatcagttatgatgacgggccgtggatcatagatatcctctcccatctgcagtgcacagaccgcatcaacggtgcctgacgaaagcagggacataagcaggccggtcaccacccctccggatgctgcgtgttccctgattgaatcaaacggagaccggccgtaccacatctgaccattcatacctctccacccccgaccggttcaagggagacacagattggtttatattcagaaaatccggggcctgattcagaaagacccatcagccggttcaacgctgcatcaaacagcgacggcatgaagatcatcccctccttaatatctgacacaacccgtgccctgcaggataattcccctttcctggaccggacctgtatcatatccccgtctgatatccggactttttctgcatctgacggatgaacttctatatacacctcattcagctcatcggtaagattcttactcctcctggtcatcgtcccggtatgccagtgccagataacccggcctgatgtcagcctgaacgggtaccgggagtcagggagctcagcaggtgccttccattcaaccggacagaacacacccttcccgtccggatgataaaaccggtcagaatagagaatagccgtgccagggtcatcagcagatacacatggccagcagatcccgtctggaaggctcacccgttcaaaggtcatcccctggtacggttcacataccgtcgtaatctccctgaagatgtcagatggatgctgatagggaaactgcttttcataccccatcaggcaggcaatctccgtaattatctgccagtcaggttttgcaagcaccggagcttcaactgcctttcgcagccgctgaactctccgttcggtattggtaaccgtcccgtccttttctgcataacatgcggcgggaaggacaacatgggcatattcacaggttttggtaaagaagatatcagatactaccaggaatttcaggttttttatcgcatgttcaacgatgtgccggtccggctcagtcaccagcgggttttccccgaccaggatcatcgcttttatccggttggaactctcaccagccttctgaaacatccggttcatgtcaagaccgggccgtgccggggcgatattctctggaaatttccaggttctcgctatcttctgatggaagttaccgtcggtaaccggcttatatccagggaagaagtcaggcagacaccccatatcacaggctccctgcacattattctgcccacggagtgcattgacaccggtcccgggccggccgatatttccggtcagcatcatcaggtttgcaatcgccctgacattatgaacgcccccggacagatgcgaaagacccatggcatacagaaccgtacaccggtccgcagatccaatccattctgctgccctgatgagatcagtctttgacacaccggtcagaatgcttacttcctggggagtataccggttttgcaggacaagttttttcagcgattcatactcacgggtccgggatctgatgaaatccttgtcttctaaaccatttcgaataatctctcccatgatgcagttgagaactgcaacatcactcccgctgtagaactgaagaaacaggtctgcctggatcgccgtcggggtataccggggatctgcatatataaacctccccccggcagcctgtgcacggacaatctgcctcccgataagcggatgctgctcaaaggtgttggaaccaagacagaagatacagtcagatctcccgatatcagggatggaatttgtcatcacccctctcccaaatgaaagggtaagaccggtcatggtcgcttcatgacagaacctggcacaatgatccagattatttgtctttaaaacacctctggcaaacttcatcaggacataattatcctcattcgagcaccgggctgatgccagcaccccgatctcatctgcagaataggtggtaagtttttgggcgatcagatgataaacggtctcccagtctgtctccacaaacacatcgcctttccggatgaggggttttttgagccgatccgggctgtggataaactggtggcagtacgtacccttcggacagagttttccttcattcaccggagaacggatattcggggttgtcccggtaattttcccatcctgaacaataagatgtacagagcacccggtaccgcagtacggacatatggtcgggacctggtttatcataacagacagggtatcctctgttaccgatagagataaatccttgcctgatcttgaaatttttgattatttatggtggatgatatcatatgaatgacccctgttgcgcaaataaagtccatagatgcggcctgaggggtacagcaccaaaaaaataccaaaagaaaggaaaatactcctttcaaaatatgtgcatcaatcgtaatttcaattattacggataatacgggcacgcagaatttattgtcagataaatgccacaaaacaaaacccctatgacagatatttccgaaaaccgggtagattatggaggttaaacagatggaaatgccgtgcagaggattctgattctgatgacgattccatcggagaatgaatttgagcttattcatacatttacgaattatttttggtttttcttctctgaccgaagacgaacggatccagatttatcatgatttatcatgaaatataggggtccggaagataagctcatagtttttacattttataaagagtcaaagaaaaaacgacactttttccctttttttctccaaaaaatctcgtatctatttcagaacatttatctatattttctaacaacctttgttcagtcgattttaatcgatcaggctggtgcgacaaatatggcatttgcagttcatgtaaacatggaacgctgtaccggctgcaacaattgtgtggtagcatgtccagtgaatgcactggaactcaacacggttaacccttccagcacagataaaatctacaaagtcatcaatggtgatgctgtcatccttgatgtcaaacatgaactttgtgcaggatgtggtatctgtgtggatgcatgtccatatgatgtgattcagctctccggtcaaccaccccaggcagtggaagcctgaatggtccggagaaaaatgcaagcgtttcaggaacagaattcgtgaacaaccgaggtatcttaatgtctacactgtttcctaagtattccaagaccactgacgggtcgaaggtgataatggagcagagacttctccagcaggtaaacaacctcatccttgacaatgatatttgtaccggatgtggaatctgctcagaggtctgtcccgaagaagcaatttccgttggggcagtcggaggagtccggagaggacttgttgatgatgctgcaagcattcatgtcgacgagacaaaatgctcatactgtggtgtctgtgtcatcatgtgtccgttctcagctcttgctctgaaagttgatggcgaagaacgtctgccaatccttgaaaaagaaggattcccgacttatgacaaaggaacggcaattgatcaggacaagtgtgtcaggtgtaacatctgtgacgatgtttgtccccgtgatgcaattgaccgtgatgttccgctctttgaaggagaggacaaagaaggccttgcaaaaggacaggctgtcgaactcaagattgagttcaaagttgacgatgaaaagtgtaccaagtgtggtatctgtggtaacctgtgcgaggcaataaacgtgctccacaagcccttcagccctgaaataggaaaggttgaaggtgaggttatctgggatgaggcatattgtgacggatgtaatgtctgtgcagaagcatgtccctccgaggcaatcaaggtcacccgcacggtagtcggacagaagaaacttggaaacgtcaatatcatcgatgaggactgttgtacctgccgctggtgtgcaatcaactgtccgaccgaggctattaccgtaaacaagatctttgaaggagagatcaccttccatgctgaaaagtgtccgggaggatgttccacctgtgttgatgtatgcccggcaaatgccatttatctcccgacaccgaagcctgcaaaggacatgaaaggccagattgaagcaaaaattgcagtcaacaaggacttctgtatcctgtgtggtgcctgtgtgaatgcatgtccgggtgaggatatcatctatctccgccgtgacagcgtgaagatcaagggcaaagagacagacctctttaagaagatcaaggaaaaactctttactccgagaacgtccaaggtcaaagagcagccatccctggcagggtctgttgaattaaaggcggtaagccagtaatagaggtgtcttatggctgcaaaatcatacaacattccagaactggacaagaaacttgcggaccgccggtaccatctgagcgataccaaccctgagtttacccagaagattctcaagaccagcaggactattgcaaatatgtgctaccagtgtggtacctgtaccggttcctgcccctcagcaccacggtcctcataccggatccggctctttatgagacgctgtgtccttgggcttgagaatgaagccctgactgacccggatctctggctttgtactacctgttactcctgtacagaccgctgcccgcgggacatcgccccgaccgatgttatcatggcaatgagaaaccttgcattcaagcgggatattgttccaaagaacttcctgcagacggtccagcttatctataacagtggacacggtgtaccaaataatgacgtgaaccgtgctgccagaaccaagcttggtcttcctgcagacccgccgacaacgcactcatatcctgaatttgtcaagggtattcagaagattatcgaccattatgaactgaaagagaatgcagacagaattctgaagggtgactaaacgtgcacgaatacgcatttttcctagggtgtattgcaccaaaccggtaccccggctgtgaggcgtctgccattaagaccagtgaaaaggtcggtatcaagctcctcccgctgaagggtgccagctgttgtcctgctcccggtgcattcgggtccattgacctgaacgtctggtacgcaatggcagcacgaaacctcgttcttgctgaggagatgaagaaggatattgcactcatctgcaatggctgttacaagtcaatctgggaagtcaaccatatcctcaagcacaacgacgaactccgtgacaacgtcaacgaagtccttgctgagattgacatgcagtttaagggtaccattgatgtctggcatcttgcagaactctattatgatgacaaggtctgtggtgtccagaagatcaaggacagtgtcacaaccccgctctccggtgcaaaagttgccgctcactatggttgtcacctcatgaagccaaagaaagagcggcactttggagacactgaaaacccgatgtggtttgaagagctgattggcgctcttggagctgaaccaatccagtaccgcaacaagatgcagtgctgtggtgccggtggcggtgtccgtggatatgatatcgtccatgcccttgacatcaccaatgaaaaactcatcaacattcaggaagcaggtgctgacgcaatcacagaactgtgtccattctgtcagcttcagtttgaccgtggtcagatcgagatcaaagagaagttcggcgatgtgtacaatattccggttctgcactacaacgaactcctcggtcttgcccagggtatgagcccgcaggaccttgcacttgatctgcatgcaatcgactgcacaccattcctgcagaaggtgctttaagggaggacaaagacatggcagaaaatactgaaccaagaatcggtgtctttgtgtgccactgtggtaccaacatcgcaggatcaatgtccatcgatgatgtcgtcaactatgcaaagacactcccctatgtagctgttgctgaccagtaccagtacatgtgttcaacccccggtcagaagaagattgatgatgcaatcaaggaatacaatctgaccggtgttgttgttgcagcatgttcaccccgtcttcacgaaccaaccttccgtaccgctaccaaggaaggaggattgaacccgttccggttcgagatggcaaacatccgtgagcagaactcatgggttcacatgcacgggatgtgggacgaagcaacccagaaggcaaaagaccaggtcaggatggctgttgcaaaggcagcaaaacttgaggatctcgttccaaagagtgtccctgtcgagaagaccgcaatggttgtcggtggtggagtcgccggtatgcaggctgcccttgaccttgccagtgcaggaatcaagacctacctgattgagcggaccccgaccatcggtggccggatgtcccagcttgacaagaccttcccgacccttgactgttcccagtgtattctcacaccaaagatggtggatgtcggccgacacccgaatatcgagatgatgacctataccgaggttgagaaggtagaagggtatatcgggaactttgatgtcaccctccgcaagaaggcccgtggtgttctgaccccgaccgaagcaaccgccaaaggaatcgttggtggtggctgtaacgggtgtggagactgttctgcagtctgtccggtcatcaagccaaacccgttcgagatgggaatggctccacgaaaggccatctacatctaccatgcccaggtcatgcctcttatctacaccgtcgactttgactcctgtgtcaagtgtggtctgtgtgttgaggcctgtggtgacaagaaggcaatcgatcttgagatgcaggacgaattcatcaccgtaaaggttggaactgcggtccttgcaaccggatatgaactcttcccgattgagaacaagagagagtggggatacaagcagtttgacaacgtcatcaatgctctcgagtttgagcgtctgatctgtgcatccggtccgaccggcggtcaccttgtccgtccaagtgatggtaagaccccgatgaaggtcggatttgtgctgtgtgcaggttccagagacaacaccggaatcggaaagccatattgttccaggttctgttgtatgtactcactcaagcatgctcaccagatcatggagaagattccgggtgccgttgcatacctcttctacatggatatccggtcctttggtaagatgtacgaggagttctattaccgtatccagcacgaaggtgccaagttcatccgtggacgtgtcgccaatgtgcttgaagacaaggaaacgaagaacctccacgtctttactgaagataccctgctcggccgtccggtcgatgttgaagtcgatctcctcgtccttgcagcagcagtccagcccaatgaaggtgcaaacgagcttcggaagaagttcggtgtatctgcatcacaggacggctggatgcttgaagcacacccgaagttaaacccctgtggtacaacgactgcaggagtattcctcgccggtgtctgtcagggaccaaaagatattcctgacaccgtagcacaggcagaaggtgcagcatccgcagcatctatcccgattcatatgggcgaagtcgaacttgagccatactttgccatgtgtattgatgagctgtgtgccggttgtggtatgtgtgtcaacctctgtccctactcagctctctcactgggtgagaagaacggcagaaccgttatggttgttaccgaagccaagtgtaaaggctgtggtacctgtggaggattctgtccaggtggggcaattaagatgcagcactttaccacaccacagatcgtagcacagattgatgcattctttgcaggaggagaacagtaatggcagacgattggaaaccacagattctcgctatcatctgcaactggtgttcatatgcaggtgctgaccttgccggtggtgcacgtatccagtatccaccaacggtccgggcaatccgtgtcatgtgtaccggacgtgttgacatgctcttcatcctcaaggcatttgttgagggtgcagatggtgttctcgtctccggatgtcactttggtgactgtcactaccttgaaggaaactacaaggccgcaaagcgtatgttcatgatcaagaacctgctcagaaacatcggtcttgatgacaggcgtttccgtatgacctttgtctcagcatccgaaggtgcaaagtggggtatggtcatggaagatgtcaccaatactatcaaggaacttggtcccagcccgatcaaagaattcaaaaaataaatattttttttacgtaattttcagtaatcttcttctttcttctgaatatcagatattggatgtttttacacgttgtcatatgacggtgggtcatagctttttacaacaagttaggattctccattcgctatagtagtcattcagagctgatccaatatccgtaccatagagccaatggtgatacaattatgtattgaggcgactaatggtgatgtttagcatatggtgatatacacgagctttcaaattctttgaggaggctagggaaatgagtataattattgaagccatttacaaaaagggagcattttatccaactgtaccagtagagatgccagataataccagagtaaaacttacactaaaaaagagcttttctgaccttattgataaatatgctgatttcccaatgaaagaatcagcagatgcgatattagagaatataaggagaagaaattcataaaatgaactcctgtgtgctcgacacatcggttcttattaagggaatattcccaccagtaagagcattaaccagagagtatataatcgggatttagacacctatgagaaatgcaaaacactcattcgacacttggagtctaatcacattgaaattttcttcccacgtgctggactcgtagaattgatctgtgttattacccggattgaagattcgaaaaccgcagacattgtatttcagtatgctaatgaactctttgtaatactggaggaatcttcgatatttgatagagccctttcaatagctcgaagaactgggtgttctggctttgatacctacatgctcgcctcagctagtttacaggattgttatctatttacagatgatgcggagatgtataccttcgccaggcaggtcgggattcgttcatatttaatccgagattcttcaatagaacttttatgctctcctgaatagacagatattggtaaaccgatatacatcttcattaccaattctgtcccttttttatggtacctcaagagggcagaaacaaggcggtaagccagtaataggagtctctttgatgtaaacgatcttcggaagaagttcggtgtatctgcatcacaggacggatggatgcttgaagcacacccgaagttaaacccctgtggtacaacgactgcaggagtattcctcgccggtgtctgtcagggtccaaaagatattcctgacaccgtagcacaggcagaaggtgcagcatccgcagcatctatcccgattcatatgggcgaagtcgaacttgagccgtactttgccatgtgtattgatgaactgtgtgctggttgtggaatgtgtgtcaacctctgtccctactcagccctctcacttggtgagaagaacggcagaaccgttatggttgttaccgaagccaagtgtaaaggctgtggtacctgtggaggattctgtcctggtggggcaattaagatgcagcactttaccacaccgcagatcgcagcacagattgatgcattctttgcaggaggagaacagtaatggcagacgaatggaaaccacagattctcgctatcatctgcaactggtgttcgtatgcaggtgctgaccttgccggtggtgcacgtatccagtatccaccaacggtccgggcaatccgtgtcatgtgtaccggacgtgttgacatgctcttcatcctcaaggcatttgttgagggtgcagatggtgttctcgtctccggatgtcattttggtgactgtcactaccttgaaggtaactacaaggccgcaaagcgtatgttcatgatcaagaacctgctcagaaacatcggtcttgatgacaagcgtttccgtatgacctttgtctcagcatccgaaggtgcaaagtggggtatggtcatggaagatgtcaccaatactatcaaggaacttggtcccagcccgatcaaagaattcaaaaaataaatatttttttataaatttttttattttcttctgaatatcaggtactcagttttctcattgtcatgtgacggtgggttatcactttttcaatatgttcgattagagtagcgaatatgattgatcaatcggacatctcatgtaagattacattcttatatgtttaaccagaagtgagtgagtatactccaccatttttttaataagtggaggattacaggggggtatcatagtatgacaaaccctgacagattattcgaactcctcatctcgctcaatccctggtggagtggattaccccaggaaacaggcataatcagagagcattaattaaagggattttgtgataaagcacacggataattcactgacatccataaacgtaacctataccgatgatataccggaacgtgaaatcagggctctttcctcgtttcaggatgttttttcagagaatatccgcaggcgtattctcataacaaaagacatcgagaaagaagaagagggtatcgaatatatcccgctctggagatggtttcttgggcggtatcgtgatacaggggatctgatggacagaaagagaaaaaataaggaggtttaaaattttacgtaacaaacatccccatattctctgctatccgctggactgaagcagcagcatcagatatcgcccgtgtgatctgatcgatcgatgccgtcacctcttcggttgctgccgccgaatccaccgcctcttttgcggtccgctgaaccagattcccgacctcattcacactggccgtgatctcctcgaccgctgctgcctgctcttctgctgctccggctacctcggtcatattcgcatgcacactgttgatcgcctgcacaatctcatcaaagatcgcaagggtcctggtcaccgcctcattgcctgcctgtacctcaaccgatgagttcttcatggatagagagacctgttgtgtcttcttttgcaggttcccgatgatggatgcgatattctccgcagacttttgtgactcaagggcaagagatttcacctcatcagcgacgaccgcaaaacccatccctgcctcaccggcacgagcagcttcgattgcggcatttaatgccaaaagaccggtctgttcagcgatgcccgtgatgacatccacaatcttgccgatctcttccatctggccggtgatatcagtgatgatcccgctcgtctcctcaaccgatgaactgatcccttccatccccttctcagccgctccggcaaggcttactcctttctccgtgagatccacggtctgctgtgccatcatagatgcctgctcagcctttgcggcaaccgaactgacggtatttgagagatcctccatggcggtcaggatctgcctgataccagtcccgcttcgttcggcaagctgactcacctcatttgaactctgggcaagcagacttgtagtgctggcaacctcttcggcactggcattcgtctcctccattccggcagaaaggttctccacctcggtctttacgccactgatggccgctcctccctggataccgatctgattgagtgcctctttgaatcggataaagtcgcctctcatctcgatcgtatcattcacccggtcggtaaagtcaccctgtgcatacgaaccggcaagtcgcatcgcctcattgagcgggacaacgatcccctcaaacgtctcattcatacccaggatcacctcccggtatccaccctggaacttctctgcatcaccacgaactgagagctttccatcaatagccgcctgactgagagtttttgcctctgatacaagcccccgaagcgactcaatcatcttgatgaccgcaggagcgatctcatccttgtcatcatgagggactggcattgctgagagatcacccacactcacctgtttgagtatggcgatgaagttattcacgagattatctgcgaactgatcgatggctctggcaagatccccgatctcatctttccgctggtacgaaagtcgcatgccaagatgcccgacgcccagctcctgcatcatgacaacactcctctggagcggggtggtaatactcctggagatggtatacccaaggctgatggcaagaatgaccgcaatgataccgatgatggcaagggtcaacgttgccgcagagaaggtctcatctccctggatattcagttcttcagccttttttacattgatcgccttgagattatcaatattggatccggtggcttcccgtgatttcgccatagccccgccagcgagtgttttggctgcatcagcttcattccctgcatctatctgtgccagggtatccttcaccaccttttgaaactcggcccagttgacatcaaaccgggcaagttcctccttttcgctgtcaatgaggtatgtcgcccgaatggcatccatattctgattaattatggatatatattcatcaatctcagcctttgtttttgcacgctggtccgggatagagagatatttgtagagattccctctgatgtacagaaaatctgcatcaacctctccaagggttgcaagcgggaccgcgcggtcatagtacatctcggtcatcccgtcattgatggtcttcatctccacatagccgacaacggctacgatcccaagcagaatcgcaaggagcagaaaactcccgaccagtttttgtcccattttcacattatccagccaatccattggtatcaccattaccaccgagaagcacccacgagggctgttgtccgtcatgtatgctcctaccggtcatcgttgtgtacatccgtttttatccggtctgatacctgcatacccaaatcattcgtttatcaggcaggattgtatcgacatacacctattcggaatgattctatgtatagataccgatttctttctgactaccagaagttccattctctcattgcgttcatgatttcaggctcatataatacagaggggcctatagtatatgacccaaatgatggaacgctcccagatcaaaaacgtgaatgtatgcttctttccggtgatggaatcagcaataccactcacatcggctaaagccacatgatctgctcaatggacgcagatgcctcctctgtggccgctgcagcatgaccggccttactggcagtgccctgaatcaggaccgacaccattcacaatggcgaatatctcccaaaacgcgaccatcactgagagttttctgatggtttttcaggatactgatatgcgttttgtataccgctggccgtaaagacctcaccggagagtaccctgactgtcagacagcgttcctactctgaaaactccaaacatgtgtcaacattcagacaaaaaccggtatgcttctgtaagtacaggaggatcttctctgatctgacccactcctgatcaaggtgcgtgaccatctcatcaatacgccgaatctgctcatcaatccctctgataacctcttcattcccgctttcttcggcgatgattgtaataatggtgagcgggtttcgtataccatcattgagaatggcaagcttttcaatctcttcctgcgcagaggagagttcttcaacctgctgtttcagctcttctttctctccggcaagttcttcaaatacgactgcaagttcctggttcttctcttatctctaaccgataggtctgcatcagcgtgatgttctcgtcgaagatagaatacacaggcgatgatgatcggaagataatagaggttttgaaagataatggtccaccctgtcatgactgatacaacactcactcccagggcaaggaccgtggttgcgatgagcaatcaggcgggcacgccgtgtgagatggatatcccagatatcggtcatggccccacccctgactgaccgggttcatcttttttatacataccctttggcacggacatctcaaacctcactccctgcccggccgtaccggtctctttgatgcgaatatgcgtaatacccagtatctcctgaataaaaaaaagtccgaatccggtattcttcccatatccccgctcaaatatgagttccttctcgtcaggtgcgatcccgaccccgtcatcctcaaagacgacaagaagtccctcctcctgctcttctgctgctatggaaattctgctgaccgctccgccatgtcgcagtgaattatcaaccaggttcacaaaaacctttggaaggagcggatcggcatatacctgccattcacctcctgcgatgacaaaatggatatgatccggtatcgtacactcagcaacacaatctgcaagtcgctgccaccggggcagatgggatccgaggtcctgatataccctggtaaactcaatatctgcctgaatacgggcaataagtcgatcgagtgcatccagttcttcaccgatatgggcggtatctgattttatcttcaccaggtcaagaaagagctgcatggcattgacattattgaggatatcatgcctcgtcacttcagtgaggagacgtaactgccggtttgcctgtctcagggcattttcagcatacttctgatcggtcatatcatggaccagctcaataatgagccgtacctctccattctcatccaggacgggggttgccgtgcaggcaaaataccgagacaactcgggaacataccgctcagccgtctctatcttctttgatgccagggctgcacgcgaagcacagggctcacagggaccagaccgcccaataagttcatagcacttcctgccgataacctcatcctctctcatcccaagcatctcgtacccggccctgttgaacctgatgatggagagatccggcacctgaaccccgaccatatctggtatcccatctatcatcgactcaatcaggcggtgtgtatcatacaggtcacgctcagcctgctttcgggtcgtgatatccaggatcaccccgacgatcccatccggctctcccttctcatccgggatggtggctttatagaagacgacatcatgcaagctcccgtcagcatgggcaacctgtgactcatactgttgaatcccaggattctcaaagagttctttgtcctttgcatcatagatgaccgcaagaggggcaggccagagatcatgcaccgtcgttccgatgatcttctcttttgaaaggccgatatatgactcaaatgcagcattacacccggtataacggccattcttatccttaaagaacacaggcccgggtattgtctcaataagccgctctaaaaaccggtgttgttcagcatggtggcgctctcgtgctttctgatcggtgagatcgatcaggaccgcatggatcagagagacggtgccggttgtatcacgggccacggatacagagacagagacagtaatctgtgccccatccggcagaagaatacaaaactcctcaccttcaatctcctgatgctcacatgctgccataagcaggctcaatacccgctccttctctcctggtataccggcaaagaggtctggaaaatacgacccggtaagttctctgcaccccttgccaagaaggatctctgcctttttattgcatcgggtgatgatgccgccaggggagagggagaagtaggcaatcggagcatgctcatataatgcctgatattcggccacaatttttttatgagcatcctttgcccgtctcctctcaatcacggtcagggtcttgtgcaccagttcagcaaactgggacctgatatcgccccctttctgcacatagccgtcagccccgaggtcatatgctctgataaccacctcttcccggcctctcccggtgaagatgatgatcggtccatcatacccctgttctctgattgcctgcataagttcaagaccgctcatcccttccagctcataatcaaggatgacggcatcataccgcttctctgcaatacaggccagtgcctcttttccagaacatgcggtatccaccaaaaatccataacctgaagtaagatatgccttcgtggcatccagaacgatcgattcatcgtcaaccagcagaacggtgatggatgcagccgggggggtttggcattggtctggcatggacaggatggagtcttgttaaaggataattcacggcatgtatgaaataatctttcggtatgtggtgctcctgccccatgttcatcgaataatgcccggaaggtccagatctgccaaaaagtattcccagccgtactgaaccatctgttccaccttccggacaggagcatcggcagtgagtaaatagaaaagcatcgacccgggcataatcagctatctctctgatatcccggataaattacaccagatagaaaaatcagacatatcagagaccgcggatatcctatgagggacaaagacgatgatgttgtcagatatgcagggattgccatgaacatgaccaatacaccagataatcctgatgagggacgccggaacgcgtgaattcatcggatggctttatatgatagtgcatgatatgatacatcacacagtatcgaaaaaagcagtatgatggatatgaacaccattgatgatgcttctcacccgatactctgttccacaaccatccagaaaaccagaactatgtgatcagaatatatgatatccatcctgtatgtcgatgatgaaccggattttgttgatctgtgcaggatatatctggaaaaacagaaggattttaccattgactccagtaatcttgcaacagatgcactcaaaaaggtagccggtgccacatatgatattatcatctccgattaccagatgcccggaatgaacggaatagaattcttaaaaaatgtccgaaataattacggagatattccgtttatactgtttaccgggaggggaagagaggatgtggtcatcgatgctctcaataacggggcagacttttaccttcagaaaggatatgataccgcaccactttttgctgaacttgtccacatgatttatcaggcggtagacagaaaacaggcaaaaaatgcattacagacaagtatttctcagctgtgccatgccgaagagattaccggtcttgggtactggtcatttgatctgaatacaggaaaagtaaccgcttcagaaggagcaaaaaagatttacgggcttggagataaggaatggacgattgctgaagttcagaccatcccacttcctgagtaccggtcactccttgatgaatctatgaacaacctcatttcaggggagagaccatatcatgttgaattccagataaaacgcccgtctgataacaaaatcatcgatatccattcaattgcagagtatgatcaggcgaaaaatcaggtctttggaaccattcaggatatcaccagagtgaaagaggtggagcgtgaacttcggaagaaaaacgaagaactcaccgccctccatgcaaagatttcaaaatctgaggaagaactggtaacccatattgatatgctgacccgtcagtcagcgaagatccgggatcgggaggagcagatccgcctcctgagcgataatctgccaaacgggcttgtctaccagctcctcataaagccggataatacacggtcctttcagtatatcagcgctggagtagaacagattcatcaggtatcagcaacgagtgtgctcgaggatccgaacgtattgtataatcagattgttgacgatgaccgtctgggcttgattgatgctgaaaatgaagcattcaggaaaaggacatccttttctcatgaaatccgaatacgcacccctgacggacagattcactggatcctgctcaggtcagtccctcatgttctttcggacgaatcaatcctctgggacggtattgaaatagacattacagaccagaaaagagcggaagagaaacttcggatgatacatgagctctttcatcagttcatgcttcattccccgatttacatctttattaaggaagttactcaggatacaagccgggtgctctatgccagtgagaatttccaggatatggttggaattccgggatcccggatggggggtcatacgatggatgaactctttcctccggattttgccgcaaagattactgcagatgactggaaagtggtgtctgatggagtggttctgaaattaagggagagcttgaatgataagcattatatcacgataaaattccccatcattgaacagaacagaacgctccttgccggatacacgatagacattaccgaacttcataagacgcaggaagcgttgcatgaagcaaatcagaaggtccgtctcctcaccggtcttaccaggcatgatattttcaatgagttgtcggtcatcatgggatatcatgatctgatagcagagactgaagacctcgcagagattcgggaatatgtatcaaaagcaaagaagacctgtgaacagattatcgccaccaccagttttacccgtgagtatgaggattttggcacggctgaaagccggtggcagaatatccggagaattatcgaatccgctcaagatgaggtaaatacggatgacattaccattatcaatgacatcccggaggattgtgagatttatgcagatccggtgatcagaaaggtctttaccacccttttagagaatgccatccgtcatggggaaacgataacgaaaatacactgtttctgtaccaaagatgagaaccagctgattattacctgccaggacgacggggttggggttcccgacgatgagaaaaggtatatcttcgggttaaggtatgggaaacataccggaatcgggctctttctggcaaaagagatcctgtcgatcaccggcctttccattcgtgagtgcggagagccggggaagggagcacggttcgagattatcgttccggaaaatgagtaccgtttcctctctgagtctgagaaaaaatgagtggtgtgaatgggtcagacggaggatagttaatacttctccgtttgcagaggactgacccaggaatgccagaacgagagggagaatgagatcagggtgaatgcatccagaggatcaaacgtgaccttaaggaagtttatggcacagtcagaggatgatccggttacctaagacctgaaaacaccgacactcccatatcccttaagatcaaaagaggtgtatggaacatatctcttcatttcttgatgcagatcccttctcacaggaacttggaataaaattagagtcggtctcgaaaaatactgcaaccctttcgctcgtgatctctgaaaagcacctgaatactcatggcaccgtccatggcggggttatttatacccttgctgatgctgcatttgccgttgctagcaatgccgatggtaccccgtctgttgctatcaacacctcaataacctatatgaaagcggtaaaatcagggaaacttatcgcaaaagcccatgaattctccaaaaaccacacccttggatcatacatcgttgagatccatgatcatgagggtgaaaagatagccgttttccaggggctttcttaccggaagagacgataataataggatatgaatccggctggttccgtacgaaagttccatgttcctctgctcacgggagtacctcaaagagttttacaaaaaaggcaagagattctacctcactggatttgatcgaacgcctcacctggattgaatacatgcactcgaccctgaaagaagagaacattgttgccagcattaaagccgggctgatagtgatcggacagaactggaatggggagaacgcattggaaacacagaaaagggtgctccagtacttcgggtttcaggtaaatccaaagcagtgttggaactggcagtacacgcaaaacgcagaggacgagacaaacgaaagctacatacaagcagcacaagaattcgagtatatttcttgaggaggggtccggtccggccccggaggtatcgccaggaacttcatgagctccacatttccctgccaatcacatcgaatcagtactcttttgttcgtacgtaagttacacaggagggttttagtagataattatcacaccataaagcagagtgtataatggaggtaagctaatgacaataatacgggctaaagtcattgataattttcatctggaactggaagatgaattgcacgtaaaaaataaagaaattttgataaaagtagttgaaaattcatcgatatcatctttacgaggtgcatggggatatgatgtagatagtgctgattttgctctgaaaattagaaaatccaagcaaatagagaccatatgaaattattttttgcctgaagatctttcttttccataatatagtcccacaaaaatatgatttgtttgattatgagagaaactgataaaattaataggtaattctcatttcgcaacctactatcagaactctaccacacaatacctgaagactgccagtatcactcaactcaattattaaaggaaccctcttgatatctgaccatacatatatgagagaagggcgctgtctcatgaacaatgttatcctgatcggtctgcccggtgcaggaaagagcactctgggagtaatccttgcaaagacccttggtatgcattttatcgacaccgatatcatcatccaggataagaccggaaggcttttgcaggagatcatcaataccgacggagtggagagatttcttgaaattgaagaggaatgcatcctctccctcaataaatgccatgcggtgatatcgaccggggggagtgtggtattaaggagccgggccatgaaacacctcacatcagacgggatgatcatatacctggagatctcgtatgatgagatggtcaaaagactaaaaaatatcacgacacggggaatagtgttggaaccgggtcagagccttcgtgatatgtatgaccagagaattcctctgtatgagcggtacgcagacatccgtatcaactgttcaggagaggcatttgagagtgtcgtggagaacgtggtcttgaagatcagagaacataccgccgttttggctgaacattcataaccccggcatagtatccggttgccacccgaacctcttttccctgcagaatgatggcaagtcggacaatctgttcatcagaaatccctgcattggagagtgctgcctcatactcctggtttcgtatctggttcagggcatctgatacgatctccgtattctgctgtccgtccgttgtcttaaactcaataacataggcagttggataatccctggtctttgggatcatgagaatatccgcccgtccaaatcctgcttctgcatttgatctgatctcatacacagtccgaagattcgccaaaaggccaaggacaaaggcatgaaataccgcttcaggcagttttgcaagatcgtacatgctcaccagatcacgggtaagatcctgaagaaccggtccaatctgaaggatcggtcttttcccaaggaaacaatggagaagtaagtcaagtcctccatctgtatttcgatacagggattcaatgaaatgctcatatgcataactgatttcacgattcggaattctcagccgatagcgtaaccggccccgaaggtcaggctgtgggtcctctgcattcagatacccggaataatacaaaagactccatatattaactggatttctcccgatatccgtgaagatgatattctctgatatcgggtatctcagttcttctcctgcaagcaacacttcaagatcccgttttatctcaaggcctcctgcctcaagctcttcgtataccaacgcatttgatgaggtattcagccatttgggtcctggtggattggggatcgcctgaatataactgatgaccgaccaggggttgtagatagtgtgacctccaaatgaatacccgttataccagtcacggatgatcccggcatggtcttctgcctgaaatgcggagaggatgagagagagttcaggttcggtaaacccgaatttatctgcatacgggcctatcataagcgagcttgcaacatcaagattattcaaatctgagaagattgactcctttgcaacccggagaatacctgtgacgactgcccggaataacacctgaccatattccggctttaaaccctcccccagccacgaacgcataaacccagccattttgtcataatatccatgtgaaaatgcctcaatcatcggggtgtcgtattcatcaatgaggacgataaccggttttttgtagtactgatagcagtgagtaatgagatctttcaggctactatagagatcattgagcgtagcttcttccatgatgatgcgatgaaatctctccctgctcccatctgataaaacaggttgaacctcagcaaaattcttatacaaacttccaattttaatacgaaccgcttctataaagtactcatacgaatcacgcttcagatcctttaaactgatatatattaccggatactgcccctgatgctgcatatattgaggaaaatcagcaatggcacagtttttaaagagataagaccggctctcttctgatcgttcaaagaaataccggagcattgtcatgttcagggttttaccaaaccgacgggggcgggggatgagcgtgactttgtttccttcaataatatcgcgtatcaggagagatttatctacaaagtatcccccatcttcaataaactctttgaaatcgtcggtccctatccggaattttttcaccgtattatcccctgaactttgttatcagtattactctttcataagcatatgtattaccatccacaaacccacagatgtatctctctttagacaaaagatctagcagatgatgtatctcttggagaaatcaactgaaaagagagcgaatatctgaaagaaacactcagcaataacctggagaatgattattccttccttctgtaagtacagaacagggaattcgggcatatcttcccgatatgggacattgaaaggctatcaggcagtacggcaaaccagatttacgtagaaggggtttcaatccctatcgggttttcttttccattgtgacttgatgaattgaaacacccttggatcatatatataaggtttcaatccctatcgggttttcttttccattgtgacctttttgttcctgttgtttgtatttgaaccatctaggtttcaatccctatcgggttttcttttccattgtgacttgttgcgattatatgaagattataagaaaacgcagtttcaatccctatcgggttttcttttccattgtgacaaaaatctattcacagggatacaacctcgttctgggtttcaatccctatcgggttttcttttccattgtgacatcactgaagttcccttaggtgttggagcattattgtttcaatccctatcgggttttcttttccattgtgacgagtttccacatcaattttcatggtatcactccgggtttcaatccctatcgggttttcttttccattgtgaccttgttaatttcctttaatgctgcatcacatactaagtttcaatccctatcgggttttcttttccattgtgacttgggtcttggcctgcatcattgggggaagtatacgtttcaatccctatcgggttttcttttccattgtgacgagtgtacatggtcacatcagtcaaaaaggatcatgtgtttcaatccctatcgggttttcttttccattgtgacactatgaatcctcacgacttcgaagagccgggcaagtttcaatccctatcgggttttcttttccattgtgacaacatctgcaactctgcctccgcttgtcagattatggtttcaatccctatcgggttttcttttccattgtgacccggtatatcacaaatcatctgttgagttataaatgtttcaatccctatcgggttttcttttccattgtgacttttacctttatgcgctgaaaccgcttccatggacgtttcaatccctatcgggttttcttttccattgtgaccggagagcgggatccgggagtgagcacacagcagagtttcaatccctatcgggttttcttttccattgtgactcgaggggctctgggggctcatgggatccggacccgggtttcaatccctatcgggttttcttttccattgtgacacctgaccggcctttatcgttgctccggcggtgaaagtttcaatccctatcgggttttcttttccattgtgacaattaccaagtttttcactgacatactcgcatcattgtttcaatccctatcgggttttcttttccattgtgactgggcaggcatgtgatgagcggaccagtggaactcagtttcaatccctatcgggttttcttttccattgtgacgagtatttctgggggtctgtcgtaattgctgtctgagtttcaatccctatcgggttttcttttccattgtgacgtaatccttgcgagcgggctttatggtacagttatggtttcaatccctatcgggttttcttttccattgtgaccaggcataagggcctggttgaatggctaaaacttgtttcaatccctatcgggttttcttttccattgtgacttatattgggaatgtgagcaatggtggatttatgtgtttcaatccctatcgggttttcttttccattgtgacattctttcagggctttaaggtcttcgctcatataagtttcaatccctatcgggttttcttttccattgtgacgaacggaaggcgcaaatctcataacgttctgggatgagtttcaatccctatcgggttttcttttccattgtgacttgctgcctttcgctcaaactccttgcgggcgccagagtttcaatccctatcgggttttcttttccattgtgacatattccggtgttagaaccgcggcgtctgcagaagtttcaatccctatcgggttttcttttccattgtgacagtagcaacaccggcatacgaagcggggttactcagtttcaatccctatcgggttttcttttccattgtgacacgtagatctcatgagcaacattgtggctgaactggtttcaatccctatcgggttttcttttccattgtgacccatttgggtctgtgtatcgaactgcacataccaccgtttcaatccctatcgggttttcttttccattgtgacacgggtcagacccttcaatgttcagcgactctgaaaagtttcaatccctatcgggttttcttttccattgtgacccggttccccgacatcgaaagcgtcccggagaggagtttcaatccctatcgggttttcttttccattgtgacctgaataccaagctagacaaacttttggcacactttggtttcaatccctatcgggttttcttttccattgtgaccatttacccattcagtaccagtccaaacataacaatgtttcaatccctatcgggttttcttttccattgtgactgatcaggggagtatgtgcaatgctcagttacgaaggtttcaatccctatcgggttttcttttccattgtgacacacattttcctgccgcccacgttacacatatctgtgtttcaatccctatcgggttttcttttccattgtgacacaccagtcgtaaccgcttctgctgctgttgctgagtttcaatccctatcgggttttcttttccattgtgactcacatcgtatcctgccttgaaatcaagatatgcggtttcaatccctatcgggttttcttttccattgtgaccagactataatcagccgtcattaccagtctctcaaagtttcaatccctatcgggttttcttttccattgtgacttgtctccggtcttcaggcataccacccggtcatagtttcaatccctatcgggttttcttttccattgtgactaatatattagacattaatccaagtggtaaatattagtttcaatccctatcgggttttcttttccattgtgacaggtcacccggtttgacgatgagagagattcaagcccgtttcaatccctatcgggttttcttttccattgtgactgtacgagttgtaatgccgggtaatgtgccggcgtagtttcaatccctatcgggttttcttttccattgtgaccggaatccatcggagttcccgcaccttcaagagagtttcaatccctatcgggttttcttttaggagttacgcagttaacttttataatagaaagatctatatatgttgacagcaccaataatatacgtgccagtaacgaaacagccatccgatgttgattatatcaattacctcatcgcagctcgatgtgacgtttcttgtgtaaaagttgcagattgttattcaacggctgatttttcgatatcacatgatacttacaaccgatttctatcaagacagtctctaactcctgaggcgttgtggaaagaagttgagccttatgttgaacgaaaaagcggctggttggttgttgatgatacaattctcgataaaattcattcaaaaaaaattgagggcacttattatcaatggagtggcaagcatcacaaggtcgttaaaggaatcggactaataacactgatttggaccgatggaatcgtctcatttccaattgattatcgaatttatgataaaaaagttgatgacaaaaccaaaaatgatcatctccaggatatggtcaatacagccttcaagagaggttttaatcctgcatttatcatgtttgatagttggtattctggaattgagaatctaaaatttattaatcgccttggatggtttttttttcacacgagttaaaaagaatcgagcagtaaatcctgacggccaaggtaatgtccaagtttccgatttgaaaattcctgaagaaggattggaagtacatttgaaaaaatttggatttattcgtctttttcactcggtaaacagaaaaggtgaaagtagatattggttctctaattttattccgatgaataatgaagatagactcaatttgcagtcaatttgctggacaatcgagaattatcatcgggcaattaaggaactttgcggcgtcgaaaaatgtcaggctaggaaagcaattattcaaaggaatcatattaactgctctctaagggcatatttacgacttgagataaaccatttgttgaatggtgtcaccccatataatgctcaatggcaaatcacaaaagtagggatttcagagtaccttcagagaccaaaatatgcgctataaaatttttggaggctcttctgcgtaactcctatcttttccattgtgacttcctgtaatcattggagggatactgggattgctcctgtttcaatccctatcgggttttcttttccattgtgactaaccttaacacggcaaacagtaagcaagtaggattgtttcaatccctatcgggttttcttttccattgtgaccgggaaactggggtttatcgggcagattttgagattagtttcaatccctatcgggttttcttttccattgtgaccttcctacctgtaagggggggagtatccataatgtcgtttcaatccctatcgggttttcttttccattgtgacaaaccgtatggccgcagtcattatgatccaatgggtttcaatccctatcgggttttcttttccattgtgactttcctgcgctgaggatgtcattgagatgatgatgggtttcaatccctatcgggttttcttttccattgtgacttcatcgccgcgttttatagcattccctgcaggagtttcaatccctatcgggttttcttttccattgtgacctgagtttccagccccgtttgagtatcatgagagcagtttcaatccctatcgggttttcttttccattgtgacgctccctctccctcatcagctcatcagatgacactatgtttcaatccctatcgggttttcttttccattgtgaccgtgagccgtggtctgacttctgacgccttcctgagtttcaatccctatcgggttttcttttccattgtgaccatcgacttcttcccgcggttcttccggctgactgtgtttcaatccctatcgggttttcttttccattgtgaccacatcaatcacagccgatgatatgcgtaaggcattagtttcaatccctatcgggttttcttttccattgtgaccctgattctacgggccttttcaagtgcagtttccatgtttcaatccctatcgggttttcttttccattgtgaccctcatggatcggttgactgaaaactcagtagccatgtttcaatccctatcgggttttcttttccattgtgaccctgccattatatctctctataaatgattcgcacgtcgtttcaatccctatcgggttttcttttccattgtgacctatggtgatgttttcgttatgtcatccgggtatttgtttcaatccctatcgggttttcttttccattgtgaccgggtcatgtcccgccggttgtctgctatccgatagtttcaatccctatcgggttttcttttccattgtgacatgtaacatctcactggtatgaccatctatccaatgtttcaatccctatcgggttttcttttccattgtgacactcgctgaatggatcggtgagtctgttgatgcaatgtttcaatccctatcgggttttcttttccattgtgaccgcagcggccagcaaagttcattcgaccacccgcctagtttcaatccctatcgggttttcttttccattgtgacatccggatatcatagatttcatcaaagcgaaatcgtttcaatccctatcgggttttcttttccattgtgacctctggtttagcatacctcctgtgagggctatacgtgtttcaatccctatcgggttttcttttccattgtgacccaggagagtactgcatacagtctagtcctacattggtttcaatccctatcgggttttcttttccattgtgacacataaatacggggcaaaaatacacgggttaggattgtttcaatccctatcgggttttcttttccattgtgacctttttgagatagacttcgctgaggagttcaaaccatagtttcaatccctatcgggttttcttttccattgtgaccttttgcatatacgcgtaatataattacacacacatagtttcaatccctatcgggttttcttttccattgtgaccgcgacattcggcacgaacccacggggcgacggactgtttcaatccctatcgggttttcttttccattgtgacggtagacatacccctggccgtcccagacatattcgtttcaatccctatcgggttttcttttccattgtgaccatcaagaatcaacttcttaaccagatgatgtgaatgtttcaatccctatcgggttttcttttccattgtgacccgtgcccttgcggctaccattttctttcttgcaatgtttcaatccctatcgggttttcttttccattgtgactttgtaatctcctgtctggacttcctcgtaaccaatgtttcaatccctatcgggttttcttttccattgtgaccatttctcaactgggtattcttcagccgtatgtgagtttcaatccctatcgggttttcttttccattgtgactcgactcaatgaaaaagaagactttcatgagtgagtttcaatccctatcgggttttcttttccattgtgacccgcgtaaaaatagcaggaggcatgtaatgacagagtttcaatccctatcgggttttcttttccattgtgaccaggatatcaaagaatatgaaatgttggaatatagggtttcaatccctatcgggttttcttttccattgtgacataggatctatccaaccaaactctgatatagatttgtttcaatccctatcgggttttcttttccattgtgacgagactgcccagagatctcatagaacgcctggtcagcgtttcaatccctatcgggttttcttttccattgtgactcacaaatgacaccgctctcgcagtcaatgcaacgaagtttcaatccctatcgggttttcttttccattgtgacgtgccaaatgtcggattaccatccgcggatagttgagtttcaatccctatcgggttttcttttccattgtgacacgagtaaaggccgctattgagatggggcaggactcaagtttcaatccctatcgggttttcttttccattgtgacctcactcgtccctgtgtgttcctatggttatattagtttcaatccctatcgggttttcttttccattgtgacctcaatgagtgcatctattgcctcctggttgatcgggtttcaatccctatcgggttttcttttccattgtgacaagggactatgcaatccttcatgatctcacactaatgtttcaatccctatcgggttttcttttccattgtgactggagttgtgggaactcctgaaaattcatcgtcatagtttcaatccctatcgggttttcttttccattgtgacttcaaaaacacctgattcaatgagatgattgatttgtttcaatccctatcgggttttcttttccattgtgacgataccgcttcagtcatcagcacacccccaaaatagtttcaatccctatcgggttttcttttccattgtgactggagttagtttaggagccataaaccggcaccggggtttcaatccctatcgggttttcttttccattgtgacggagtgatgaatgattgaaaaagagtgtaagccattgtttcaatccctatcgggttttcttttccattgtgacgtgataaaaggattagaaaaatcttcaccagaagggtttcaatccctatcgggttttcttttccattgtgacccgaatatgaaagagatagagaattgcctaatgggtttcaatccctatcgggttttcttttccattgtgacataattacccacgcgcaccaaaataagataatattagtttcaatccctatcgggttttcttttccattgtgacccagcttgagctcataacgagtagtcctgaacaggtttcaatccctatcgggttttcttttccattgtgacaattttttaccaggattttggtgggatttgatccacgtttcaatccctatcgggttttcttttccattgtgacgcagttttgacttttccactctcgacggtacgtcagtttcaatccctatcgggttttcttttccattgtgactgtaatgcttgtctctacactgaatagcgaacccgtgtttcaatccctatcgggttttcttttccattgtgactgaggcaattttctaaaggggggattacaataacagtttcaatccctatcgggttttcttttccattgtgacctgacctcgttgatggtgagagtccggtatttgggtttcaatccctatcgggttttcttttccattgtgaccaggtatcacagggagttccattcttatcaacgaggtgtttcaatccctatcgggttttcttttccattgtgacatggcatcatcaaccggaatgggtcagtcggatcagtttcaatccctatcgggttttcttttccattgtgacgacgatgagggagatgattcaggaggagattcagaaagtttcaatccctatcgggttttcttttccattgtgacgcgatcattacctggaataatcagattgttgatggtgtttcaatccctatcgggttttcttttccattgtgacctgtagttgtcggatcttcgtagttcatgcgttctgtttcaatccctatcgggttttcttttccattgtgacggcagttactgacggactttcgacggtgcagaaaaagtttcaatccctatcgggttttcttttccattgtgacagaattggagatcatcatggtaaacagcaacattggtttcaatccctatcgggttttcttttccattgtgacagttccgttcgacgtcctcaagggctttttcgaatgtttcaatccctatcgggttttcttttccattgtgacgaggccaacctccgaaccgttgatcgaaacatccctgtttcaatccctatcgggttttcttttccattgtgaccgccacaatatttgtctgtttttatcttataattgattatcgttctggaaaaaacaagagatgatcatggatcattatcatcccatcaccttatatcctgtcatgaaaagaaacagattatattacaacctgcattttatcaggagatacttctcctaactctgtaatctttccctgacatcgttcacataaatcatatatcctgactctgtcagtatcttcaataagatcggcaatactatgaaaaagctcaaccttgtggaccggatttatctcaagctcaaacacactatactgtttccatgctccatacctctctaaaaggcgaaataacttatttctaatcttatccttcctgatatcataggtaataaccaaccgaaccatgcaatcacctggcataaataaacgggtaataccctttcagctcaccacaaattgcttttcggaaaataattgcctgaatttgaatagccttctttcttgagacagaatacttaaaacgaggatgctttaatgactcctccatgaaatcatgataaaaccccagatatttcttaaaagccgtatcattcagacgcgacccttgggtaaagtcatcctttgtaatcatccgtttattaatcagccgtgcaacaaacgcatcgcaaaaaaccggtctgaactcttcaagaagatcaagtgctaatgctggctttccatgccggtcaacatgcataacccctataaaaggatcaagattgtactgacgaagagcactgataacctcagtattcaccatcgtatacgtaagagagagcagagcattcagttcatcacggggaggccttcttgtccgtttatcagatctccactcatcgggaaggctcgaagagagcatcggaaaatagatacttgcagcctctccttcaatcccccgaagagaatcaacagaaaccgcatggagggatctgtcccgtaattctttcagcaaagaaggaacttcaaccctcttccttgcaagaaaaacacatgaattctgtaatttggcatgaataatctcacgacagatagcaagagacttctcttttgtaatccctgcctgatgtctcctcacgagagcaatggtattcctggaagggacaaatgaaccgaaatacttgccaaaattggtaaaataattgatcacaacttctttgtcagaacagtgcttaagaagaggagtagatacactggcagaaccaaaaacattcattgtgcacactttttccaaaggaaatgaggccacaatctctccatcagaatccttaacctgaatccttcctccatccagagatatcttcccatagggggtagttatataaattgtatcatcttccaaaagcccttcaggaggtttgggttctcgttttgattcagaagcattctctatatggacctcattctcaatattcatcttcccctccttcaagaacatgagattcatacggcagacaatagagttgtacactacatttagtacattttttcggattatcaataaacccagggattgaatcaggggtcattgacctgatatcctcaatgacactgatagtcttctgttttattgaatcagtcagagcaatctcggccctccggttcgtaccaaataaatacaaaatcccggtatcaacaggtttcccaagatactcctcaagaagcagcccatatgcacataactggataacatcattctcaaaatacctgtccccgcgctttcgttcaataggtttcatcccatcagactcatcgatgagatcaattttaccatgcaatccaagacgctcagaactgagatagagttcaaatacataaccgcccctcctcccctgtctctgatgctttctcctcccatcaacaagaaattcattaactccttgtgtctggtaaaattgtaggtaaaaaagccttctcgggcagtataaaaattgattgatatcagacacattgatcatgtcatcaatccaccgggtcttaagtaccatgcatcctccttccaggaatcaatcaaacctggcatttacaatctttgcacgtgcatacgagactcgttctgcatctttgtaattcacaactttatattcaaatatctcaccaggacccagatttgagacataatctgaggacgtagcaataaccggtccattctcactttcatagaatgatacctgaactgacgcataggccagattagctttagctgtattctgaattgttccccgtgcaacattatgtttgacataatcaccttcatcacgaagagaatccattttcagaatgaggaagtcgtcaggattcaaagtcggcgttggggtgggcactgctttggatgagagatgcaaagacctgagctcaggaatagtcttggaactgcctaatactgtctcatacgttcgaagaccaatcacttctccatacatatcaacaagatcagactccctcacccgaccttgagaaccgtcataatttacccagtaaacaccatcggtatactgtccaaataatgttggaatggttgccactcgaagaatatacctcccactatcagactgtgcctgtataacctggcctgtgatatgaataaccttaccctgatactgctctataccccgaaagacagaatcatatccaggattgatagcaacagattgaatctcctgtaatgacatcccatcatacctgtttcctgtcggtacatcagtacatccacacatggctatagctacaaagagaataaaaacccagattaaaccaatatcttttctcatttcaatcaccataagctgaagctttttcaactatttcctggctattaaaagcctggatgaagttttaatcaattcctaatgggttttctaaaaattacagaattaaaggaagatctctctcataagaaagactctccgctacagcacaatctgctatgaatgcatcctgaccaatagcaagacttccacctttatatgagattaaagaggtataatcgcccaactcatagtattttctagattgatacgctgatagatcaagataccggcagaagacaccttttaccatgagttcccgctcaataagcgaaagaccaggaatcggtctcttgtcatcatcctttaccacaggaaacagaccccgctccttgcacgggatacgtctcttttcaggaagacagatctgttctataaccctcccttccagcttcaccgaacggggctttgtacgcatacccgtgacataggcaaatccaatggtcccggtctcataattcttaattgaggaccggagatcttcaggcacttttttcacaaacgcctcacatctgagaaattcaatctcggtccaccggagcagaaagaagagatcataccgctgaatctttccggagggctcataatagatcacaaccgaaaagccacctcctcgaaacgggctaagttcggccataatatccagaactgaatcctttgccttatcaagaggaatgagaaacggggagatggagcgaggatccagagaaatatcagaaaaataatgctggtacatccgattggcagattcaaccaggtattcttcacgggttttcgtagtcataccgccggttttagagagaaaacccttcttctcccgacactgaataatatctgaagccaggtaaccataggcccggtgacagatatactcccatgcctccaaaaatccccatctccaccgaaaactcgtgtagacccgtgaatcccgcatcgtccgttccagtccatccttgagttgactcctcgaaatcgattcatattgagagaaatatgaacagacagactctggagcaaagcagatagcccgatacaaaatttcagggtcagggtttcgaagtcttccaaaccgctgaagaaattcgctcacagagaaggcagagaagataaggtgctgaattgaataatcacccttaaaatcaattcctacttctaccgctttatttcctacgaggatatcaaatggttcatccattgagtcctttctaaacccgctctgctcacagacccggtaggatgtattggcccgtaaaaactcactaacaacagcaacctcaatagcactgtcaaagataattgcagtgcggacaccggataagaatggttcaaattcaaagaagcgggagataaaaatctcccctgatgagaacttcttagccggtataaaggacatctcaaccggaggaagaattagccgttgatcaacctccttctcatcacagaattcatctgcaatgataatatcccctccaatcacgtccctgatcttctcaatcaatcccttggagggagtagcggagagaaagataaatttccgaatagagcaatgttttgatgagatcagatcgtcaaagaggaagagcaggaaatcagtctgtttcagatcatagagatgaaattcatcaaaaattacagaactgacgcatgtcctgactgcactttcaacatagggatcaatgaatacattctttaatgcaaggacaaagatatccggattcgtaacaataataccccctccctgagttgacatcttctgaagaatgtgcgtgatcacctcacctttcgatactctgaccggatattcatcccgtaaggtcgttaaccgttcagcatccaaaaactcaacctgccgagaaggagcgagggtatcgcgtaaagatgaaattgtccggtactgatccagagcaagagcatttgtcggatataatgcaaaaaaaacaccagtatcttctccggtgagtgccggaacaaaccacgattccgtctttcctgcaccggttggagccgtaataaatagaaagaactcgtctctctctttcatgaccgctcgagtagtaacctgatgaccatacggaagaaatggttcccgaagtggctctgcatcataccttggaatggacaacccttcaattatcatgatcgaatcctttgtaaaaaccggattgaagcaggaaaaacaacatcttccttcttctcttttccccctctctgtatctgaatgtattctccctcaaaactaccccgttcaataacatcaaatggctgcattcgtttaaacgaaatatcacgggatggaatctgggtcagatcatcaaccaataccgggtgattcagtataaatgaccctttttttctcgtgacagggcattctgaccaggtaacggaggccttacttcgtttcttaccaagtcggatatagacaggaagatcaggttcattcccatcaaaggagaggacaaagaagacaaatttaccaccaggaaggatctgtttacgcactccatatttcccggttggagaattcatctgcttttcataagtgttgtattgaatatactcatcacttctggcattggtgatctcactcgcaaatctgatgctttttacgggttttgcgggagagacatacagttttgagtaaaaagacgccgtatcttcaacataggtcggattttgtttagcagaacctttctttaccggaacattcacatatctgccactacagtacccgagagcataataaagagcagtattcagtataaggggtctggttgtatagttattccccggttcaagagaggcgaagaagagttcgctcatcatctcgagaacaccttcaaacgctctgactgaagactggttgttcatacgctactccagacccattattgatctgccaggaaatcagatattttttcaatctgagtgatcagaatttcttttatgactgcatcatccttcattgcgtcaagaagagcagtcacctctgactctccaaggtcaatcccagatatcctatgagtcttcaataaatgttgatacacttctagagcattctttttcacatcatgaaggggcagactgtcaagttccaagaccctcttcaaagattcagaatcaggcagacgtacttcatcacctccggcaagccgtaatgcgacaccccgagaaatttcaagacttgaagggccttcccgatttgaggcaaatacccctaaaatgtgatttctcgtcttaccaaaccgtgtcccggtcgcaccataccgggtatttctgtcggtaatgttgagaaagaacaagacctcttcacaagttacatcacgtaatgtgacaacacagggaaataacgttccttccttgaagaaatcaggttcacggatccctgatgtcgctttcttcgcataatcatctcccggagcgttctgaaagtactcttcaactacagaattaatacctcgaatggtataggcttcatcatacatgactcgagatgtgacactcatatcaccttctgatgcagcactaccaaataatgcacattcagggcatttctgacacatcttcgtcacttccatcgagcacccactccaaccacctttcttgtagaaggagttcatcttttcagcgattagatccctttgtaatgcttttgctatccgcctgtcactggcaacctgttttctaccaaagagtttcccaacggtcacttcttcatctccaatccgaatgatagatgagtttgcttcagttccatcggtcgtgaaacgtgcagcactctgcagctcacgaagaataagaatgctgacataattctgttttggttttctctccggcttttcgagagtatagggtttaatactcgcataaaatgactgaattactttatctgccataattagttctcctgttctgatgacaaatcttgttctgattcgaatgcctcttttcttgattcgaaatactcttccctcagctgtagtgtggctgaatagaatccatcagcgagatcatttgcagcacgctttaattttccaggatcgcctgaagctacctgatagaagatatgatccacaaaatactctgcaaatgatacaatcagactgaagtcgtataggcccggagtccttgagaactgatcatctccagcccgctttatcatttttaatagtctcccacttactgcatccacataatcctcgcgaggatactgagatcctctctttccaagaattgctttaacagattcgcgaaatagcttctccactttatgggggtcataattccttggaatcgctacactaagcccaagacgggcaagttcgtgaattgatgctactgccatagggttttctccaaacgtgtcaagtttaactgcctggaaaataaagccaggatactctgatctgataatctctccatccacttttcgccaacctctggcgctattaacaaaaccacccataccacctttctttttatcctgctcatatacccgcctgatctgtttcaataacgtactccctggaaacggatgatttcggaatgtctgcaaaaatcggacaaaagctgcatcatccattcgaatctcatatcccatagaaatgatcagggatgctgtcatgagagtcttttttagatctgataatctgattctatctgaaaaaattcttttaactgctacatgaggggcctccaacagaacaaactctgagaactcatcgccactagtcatacatatcgggttttccccggcaacaaccctacagccggtaacatacgccagaattaatgcaagatacgacccaaaaaaccaatactctccatctccgttcctttttttattaaaaacgaaatcgaacgtggaattctgataaaaaaagcccagacctgcatattgacagatgtttttcctaccggtttcagcaattaaaagctcaattattgaatcctcggaaggtacatcctccctcaaaaattctcgggctaaatcaagtactctcgttccggaatcgccatcaaaataatttgcaaactgactgaagatactggctgttgtatgactgaaatgataatctgggataagtctgaagtatattttatcagagcctttcctaattccatgaccgatggatcgaagtcccagttcaatctggacaggaactgatacatacagactcggctcacttgaaccgatgggaacacggtttgagaaggtatattttagcatactgacatcttttgatgtcgtcttccgttctttatcataaggtgtatcattggtcagacgacagatgccagtcccatcacaatacgccttaaacttattcgttttattctcgaacgagccatagagcatagatccattgatactcaggttctcacagagccataccagaagtttttctttatatggatacaggatagcagactcaaatttctcaaggttctctgaagaaatagtagaaagatactcgtcaaccagggtattcagataagaaattttctcctgtattgaagcaatttgtgagaacgctatgccgttaacctcccggtcaagaatatcacgtgcaatagcatacgaataattccaaaaaccaccaaccgaatggtgatcctgacccctgttctcggatgcgtaggtgaccatcttttgagtaaggtcatcattggtctgaaacatcctgcaggcctcaagaaggggatcatcggtcgggagagaaccggctttgataagctctgttatcacatcttttcttattcctgatactgctcgtgcaagagggatgattgactcatcccagccggtgtcaacaccaaaatcggaaaggatgtgagaacgatatcctaccatacttggcatgagcccgattccagtaatggtaatcagcccaaaaatctcttcttctccaacaaagacagaatccggcacgagagtatacttctttgcttttctctcttcaccatggcagataatcctgacatctgatacagggatgacattcccgtcaactgatatacttttgatgaagtgagctgggacatcaatcacttcagcaggaggatactgcatctcaagatctgatttattgagagtcagagaaggagtagaagtatctatctcaaaatttccggaattatccttttcactagtcatcactgcagcagcgagaaatgcttttatgacggtgtgaatacctgaataaaagaaaaaagactcttcaactgaaaaaagaccttttgaaccttgtacctggatatatttctgaagcttctccggtcttgacagcgattcatgagaggactggatctttttcttaagttcctgatagatctcttcaatttgacttgcttgagtaaattcaaaacggctattcttatcccccagataaattactcccttttcaaaaaacaacagggggaagagggcatattgtttggcccattccaatactgcagcatgaacaacgttagataacagcccaattgattcagagaatgtatgataaaaaaaggtctttttcgcatctataaaggcgatatgcttcttcatcccctctgtgacaactggcatttcaagacttgcaaaaatatccgcaagcaaaacccagtttttataagtaataaaggtgtgtgacagatcaccatgaaatccctgcgtcgggtgtgttgcaacagcaacggagagaaaatcgtttggcgtaagtgctggagcaaaaatatcagcctgaatggcatgggcaaaactcatcacctcatcttcattcagatcaaactggtctctccagtcttttccgatcgtcttatgaagatcatgaatggaaaagagggcgattacctcccgcaacttagagacagggagataatgtgcagaaccactttgaagaagcgttttgttcagttcaatgagtgcctgaattccattccggacatgatttatcattggctggtcggtcttgccgaattcaacactctttgccggcatataagcatattttgaggttcgaagcggatggtcgatcgtctgaaaatattcatgcaggagtagatcatagtcctcctgcatatttccatgatcgtcgtgcccttccccaaacaacatgtcatgggtaaataccgatgtaatttttttagttctcataggattcctctactacagatacgattacctggccacatccccgtgatacacttgatccaacaccacaatattctgcaaaataggcaagaataagagaggcattccgaattgctgcgggagcatcactggtgaaactatagtggcatgttccggtaaatccttgtttaaaaatgggacggtgatgctgtttttttgtatcatatatggtattcgttaagacagagtgagtcctgtatgtctggggatgaggagattccagcagatatctcccaaagtcatcgcgatttagcgagagacgcaattcttcaggacaaacctgattatattttgaaaggatggaaaaaaatacagcaatacgatttggaaacatctcggtgacacggctgttccgatactgaatacaggttggagtaataaagtccatctttactgcaggtctttggcactctttaaccttttgaattatatcctgaaatgattgatattgtgtttcaaccgaacaaatacataattctccttcatgaagggaaagttccttcctgtcaagtaaaaaaggggtgatgatgtgagtaaagagatcttcatcctctggatccgtaaccccgatcctccagtgatatacctctccttctaatattctcttatgtcctttatggaatgatttctcaaactttcccatcaatccggtggttgaaagtgacgggagaggtgagttatgaattttcaaactggtacttgggtttttctcattaataaatgagaggagagcagaatataactggtatccatcactgagtgggatatcgaaagaagtttttggggaaactgttagatggataagatgcataagatataatcagagtaccttatcataaaattatctttacgtgtagagattttttatctcaaaatattgcatcagatgcgaaattatgcaagagatttatcaatatgaaaacctacatctctcccatcggatttgatacaactcatctcctcgctttgttagtacgatttggcatagagtctcatgatgtagtaatcctgatacgacctattgaggatgatgaccgttcattccgtgcaattgaagagatacaggagttaatacggaagataggcgatgacattactattaaaatcctcaaggttgatcatcgtgattttaccagcatggtatattccttcgtatgtactctcaacgattcagcaggaaaacctggaagtaataataaattacatgtaaatctctctggtgggccaagagagatacttactgcactaacagctgcctgtatggctttatctgataagatacatactgtaacctctttctcagatattgatcgagaactgcatatcatctctctccctcatatcgcaaactcgcctgacgataaagagtatcagatcttatgtgatatcaaaaatcatggccctacatcttttgcagatattgcttctcgattgcaaatttctgaaagtaccatctcgcgccaatgttcacgactttcaggtcttcagtggataacgattgaatcaagaggaaaaaataaattcgcgactatctctccttcgggtgagatcatgattattcgatataatccatcttatgatgagtaaataatacaataggccatcaattgcaataacgaagcccttcctcttaaccctctatcctctgatatcgcccatcaactcgcatttcggatgagaattataaaaccatctttaaggattgataataggaaggagttttggagggtaaaaatatattccaggatagagaatactatccagtggggtatccacaaaaggatgatcttcgctatccccatcaatgcatacgttaccatttccttactcaccggggctccttactgtatattgacccggtacagaattctcaagatttccttcaaagttatcctctcttcattgaattccgacaccatgagaggagaaaaattttatccttgatgtaagatagatatcttgatccaacagtctttcctttggggattatacggttgattgaactcaaactaggtatcgacgaggttctttaatttattatccgcacggcatgttttccgacattacagaggatttcaggaagattgaaggagactggcaggttagctctggataccaatgcgattattgaatgagatgttcctctggcatctcgtgatagtcatttttctttagttcaagatttgaaacttgttcaatgggacgaatgaatacagatatctgctggttgttacctcatttcaataatctaaagaattattagactttttttgtatacaataatctttcaccttccacctaccagatagtaccagacccaatccactcacccacagatgtatctcccttcagacgaaactggtgagagaacagatgaatcttatacggcgtactgtcctgaaaaacagacagcctggggacctatccggaggctgataccatcattaccctgcatgccctcatatcaccccatacctctggcattgccctgtttggagtttctggagacgaagattctttccgtaccatcaccctcagccatcgtgacctctatcctcatgctctcccgcattacctgcttgccgagacgattcaaaagataaccggcatctcctcacaatcctttcaccgggctacctggacgattcatgccccggcaccctcacctcaaattccccagaccaattattgtgaaccagaattcaggcaggcactcctctcccgatatacccttccaggtctcatcatcccatacgaaatctgtcttgagacgctcacctcccttcgggcatcaccagatattcacataggtgactcaatagcctgcctcctcactctgatggaatcagcatatatactggtcagggacggaaagttcaaaccagtcctcaccctgacaccagaaggatatcaggcagactgggtcccggccctcctcccagatgatctcgtatggctggcccggtatgcagccgctatgccgccggtcatgcgatatgcctctcccctggaggaactgcccgaacctattcgaaaaccggagcaaatcatctttgctggcctctccgggatgatggagaccattatccggcaggcactcagacagcaccctccatcgatccggccaggaaagcggatgatggaacaggaaaaagatgcccttgccttcatggctcaactcaccggaaaagacctgaatacgcgggaacatgaattggatccgatctttgcagagaggatgaatcactggctttcgtttcgaagagagggatatatgccctttcatacctgtatcatcgtacaggaaccaggaggggaggacctggaaccctggacgatacgcctgtgtatgcgatcagaagcagatcctgatctcatcatcccggcagggactatctggaaccttcccgaagaatcaggcggaatcctcccccctgggccggttctcatccaggaactcctctccggactttcccaggcagcatcagcatctcctatcctgaaagcctgcctgtccgggtcgaatccgacgaccggggagattacactagccgatgcagcgacttttcttaccacagaggttcttgcagtcaaagacaagggatttgacgtcatcctcccgtcatggtggaccgatgagaagtacaggccccggatagaacttggtgcacagaagaaagggccggctcacccccatgggatgctcggaatatcagagcttatctcgtttgattaccggattgccatcggtgatgaatcagtcactcctgaagagttctggcaggcagtcagacaaaagacgccgatcatcaaagtgaagggacggtggatttatgggaatgcaggtgccctttccactgcactctcacaatttgagcggcggtacatcaggggaaaatcacaggcaggggatctcatccggctgtcggtcggaggatttgatggtccgatgactgttcaggtcaggggaacagacgaatggaccaaagacatacttaccatgctccgttctacccaggatactgccgaatttccaatcccacaaaccctgaacggtacactccggccataccaggagatcggtcatgccttccttctgcgatgtactgagcggggatttggagcctgtcttgccgacgacatgggactaggaaagaccattcagacgattgcctggtttttatcattaaaagaacaaaagccggatattggtccggctctcatcatctgtccgatgtcagttgtaggaaactgggaacgggagataaaacggtttgctccttctctgtcggtctggatccaccatggcatatcccggtgtcgtggggatgaattcatcgcccatatcggccggtatgaccttattctgaccacgtacaacctggcaagccgggatatcgatcatctcctcccggtcaggtggtctgcagtcatccttgacgaggctcagaatattaaaaatccgaatacgctccagtcccaggcgatccgggagctgactgctgaccggagaatagccctgaccggtacaccagtggagaaccggctccttgaactctggtctatcatggactttctcaatcccggatacctggggtcgcagcatgcattccagtcacggtatggccatctgtcaggaacagaacaggataaacatgggaccacagagcttcgtctgctcatcaggccgttccttctccgacggatgaagaccgacacgtcagtgattgctgaccttccggaaaagatggaatcacgggttttttgcacgcttacccatgaacaggcgaccctctaccaggcggttgtcgaagatatggcacagtctcttgagacggtaaccggacttgcacgacggggtgtcatattccgggccatcaccagactgaagcagatctgcaatcaccccggtcttttcatccatgatcggggggttctgcccgaacgatcaggaaaagtctcccgacttcttgagatgctggaggaggtcagtgaagaaggagattcggcccttatattcactcagtatgctacgtttgcagagtatcttgcccgaatactcgaggagaggtttttaataccggtattcctcctcaccgggaagacctcacgacgtgagcgtgaacgactggtcagggagtttcagtcatcaaaagagccatcattctttgtgatatcattaaaagcaggagggaccgggctgaacctcaccgctgcgacccatgtatttcatgttgatcgatggtggaatcctgcagttgaggaccaggcgacggaccggacctaccggataggacagaagcagaatgtgcaagtacacctcatgatcgctgccggaacactggaggaacagattgaccggattaatgcagaaaaacggattctgggacgggaggttctggcacagggagaggatctcctcaccagtctctcaacagaggagttacttgatatcgtctcactccgtgatgcggtgctctccggggaggaggaggaatgacgagaaagatgtggtggcagattccaggcacactcccggtcagtaaaaagattaccctgcaaagccagtacgggccggttgggaagaactggtgggcctcccggtttgtatcggtccttgaggagtatggagagaacggacgactcaccagggcaaaacattgtgccaggaacgggtttgggaattccatccgaatcggtccgggtgagatgagtatggggatctgttgcagcggaacagcaaccagacctgtaggattgttattcccccgattctccagggaggtctgggacaatgtcatcgatacgatcaccaacgatgctgccctgaccggctcactcataaccggagagttctcgcgggatcttgtggatacgctggaaaagaaggagatatttcttattcctgaccagtatcggagtgttcgtgcctactgtcactgtagtgatgatcagaacccctgtatccatatcgccgctgcatggtattatcttgccgaggttctggatgaggacccctggatactgtttctgcttcatgggatgacgaaggaagaggtgataagccgggtacagacgtgccggcttcaggtatcccatccggctgtcgggtctgatgtgacagcaggaatggagcagaagaccactattccgaagaccggtgatacccggagtttcttctcatgcatcggggagagtgatgaggtcctgcgtccggtaccggagcgaaaggtgtcgcccatcctgctgcttggaccggccccgtaccggctcggagggaagaatcttgaggagcggatagagaaactgtatccggttatcggtgcgtatgcgaaaggagagatggatcggatgagggagaaatcatcccgtctgcgccatcgatgagtctcaaggccgattcggatctattttatggcaataaaagagatatcaggtatggattataccttccaggatatcctcaaccaaatctttgataaacagaagagagattatcttaccattacagagttgaaaacctccctcccgaaaaacattgaaaatttcctggggcctcagccaaaaaaaggaaccaataagaaatttatcgagagattaaaaccccatctttcggaggcctatacaatacataaaaaaggagccagcacctaccttctccgggcgccaattcaggatattatccacgcatatatcgttcaaaaaacctctgtaagcataaggaacgtctcaaaaaaacttccatttcaaaaagagctgatcgccgatgcattaaacgcccttgtccaatccggggctatacagctgaagattgttcccacgtcacgggattatatgatacagatcctcgtcccggaacggccggatccctttcgtgagataaaaaaggcatacgataccatcagaatgggcaaaaattatgtcaagatctttgcactccgcagatttctcaactggccaaagcatgtatttgactcagttattcagtcattatgggatgcaggagtcgtcgaacttcaggcaagtgatccctacctcctcaccgaggatcaacgagccgactcctacatggataaaacacataccttgcgtattcttctcatctggaggaatgaatgaagaatccacgggagatattgcaggaaaataacccattctcatcacacgcccaaccagacccctgggtgaatcagtttcccaccatctcatccatcaatggtgatgccttcacacacatcaccagcattattgcgtataaacagaaacacccccatgatccggttggaatcctggtaaacggtgaagcaggaagcggaaagacgaatatgatcgcccgcatacgggagtactgtcaaagtacttcttttgacgtgaaattctcaacaatacggcctatcatcaactataacgctccaatacagcatctattccatggaataatcaccaacctctctcaccccctcaaagactcatttcggtttacccagattcacgccatgctcttctcgatgatatcggagtacatcaatcaaaaagaagagtatagaaagttattccagccattcaaagacaatccggagaaattctttacacatttttcagagcatgaaaaagagcgaaatatcctctacaatcaggtgcaaacctggataatagacaagataccggatatcgatcatctcttcatcaggttactctttgcgtgtggtgacaaagacctgtttcaccctgcacgcaaccggctccttggacagattgcagaccctgacgatgcatcccttttgaatatcccgttcaaagagttgtcagaagctgaagcagaggatgaggcgagtacatttcttaaatcactcggtcttctcctgacctttctcaatcaatgcctgatcgtctgctttgatcagctggagaacctgtacacgggagagcatcaacgatcattcggactgatgaatcagattatcctgaatgagacctctgccatccttccccttgccttcatgagaaccctttactgggagagatttgaagagatactggatagatcagtggttgataagatcgggatgaatcaggttgatcttcgtggatgcacagaagaacagataacggagatcatcacctcccgtatcaggactgtatttcccgatacctggaatatgcttacagactggcttatcccacaggtattacgggaattatcatcccgtggaaaatatccctctccccgtgaggtcatcagcaccgcgaatacgatcatcaggatgaaggatgaaaaggggaccacaaaagagatcccccttccttctccggatcaggtcatcagatcggcatgggtgcaggagcatgatcaggtcctctcagatctggatgcatggccgcctgattatgaacagataaccagtgctttgcagatttatctccaatcacacagggttgcattcacctgtaccagggaatccagaaagaatatcataacaatcaatcatacctcgaagaattgcagaattatcatcaataccaatagcaatcatagcagcatcggttcaggttttacaaaggggatacagtatcttacgaataatccaggctctttatgcctgtatctgactgatcccagatgtattgtgaccaaaccgacatggacccagacaaaccagaagagagaggaatttcttgccgccggagggcggattatacaaccatcagaaggtgagatcgcacggttttatgccctgtattccctcgtctgtaaggtcaatgagggagatattcagattgagactatccatggtcttcgtccgataattcgggatgaactctcagcctatgtcgggaataaggaagcatttccatcccttataccagcaattcctgcaggagttccgggaaaggtccctatagacattccttcacaagagaagcatgaaaaagtagactcaaaaatgcgggagataacagataacgcagtacacaccgctctatgcacgatcctgtattcccgcccgatgcacatcatgcgggccgatatactcgtccaaagtcttcaggagaacggaatctccatgacttatgacgaactcatcatatggtgtggaagacacccggctgcatataagataatacccaatcagcagggttcattgatcatcgcaacaggaaaagggcccatatgcaaagactcttcgtaagtgaactccatctctgccagcactgcccacggctctttggatatgcctgcaggggcgagaaggatgcatggagggtcggacagaaaggatcaggaaaccttcccgggaagcggtttcataccttcgcagatcaggtttttcgacatattacgcaggagaagacaagccagcatgcctttatcaccgcacttcaatcacctgatcctgatagtgcagaatcaattcgagagtttatcaagaatgagtttttcatcccatatcttacaaaacatgcccctcgcctctcacatgaacagatagaggcatttgcagtcgcatgcgaccgatggatacgctatctcagagtcttcatctcccctgacgggacgggtattgaggatccaaaaaaactcatatcaaccatatttcactcatcagaatacaccatgagttctgattttctatgtgacgatggagaagtggtgaaaataagcggaaggcctgatgctcttctttttgatcctgggacacaagaaccggtggttgtagagtataaggggagaaaagagtcagatccaacgcaggatcttgcacagacctcactgtatgcatggctcgtctcccggtcaatcggcatcacaccacgggttgatatgctctatcttgaagaccccgtccccctcgtcagatatgactcatctgcgatacacactctcataggaaatcatgcatcactcatcactcttgcacgacggattaaagaaggccatctcccggttcccagatgtaaggaccctgacctgtgcaaaatgtgcccctataccgcatgtgacactgactttgaagtgattcgtcctaatacgccacaaaaacaggaagaagaagtcaaaccgacggatacccgaatcccgcatgatctctctcttggagaggcatatctctccaggttggtcgagaccctccatctgctttcaattccggttctcccggcaggatttatcttcggaccgcgatttatcaggctgaagattatccctgatctctcgaaaagagtcacgttttccaagattgcgaaccgtgcggttgatatccagcttggattatcgctatcctttcctccccttattcaggcacaaagcgggtatatcagctgtgacgtaccccatgatacctggcagccatgcgatgtcagatccctgatccgggatggaaaaccatcatccaggtcagtctgtccctttccgatcgggagaagaatagacggatcggtcatgatgggcgatctggcagatccggttatgaccagttgtcttatcggggggacatccggatcaggaaagagtgaacttatccggtcaatcgtcatcggaagtacactcatgaacccgaaaaaccaggtctcattcatacttatcgatccaaaacgagtgacatttaccgattttctctccttcccatctctcttcatgccggtgatcatggatccagatatggctatcacgacccttgatgcatgtgtcagagagatggaggaacggtatattcatctggaaaaaacggggtttacgaacatttcaaagtacaataccaggcaacctgaaccgatgacccgccggatcatcgttattgatgagtatgcggatcttatcatgaaccgggtcacgaaagaggctctggagactgcaattcagaagattggacagaaaggaagagcggcagggtttcatctgattctggccacccagcgacctgatgcacggataatcaccggcgtcatcaaagcaaatcttcaactcaagattgggctgaaagttacgtctgcatctaattcacgaatcattctcgatgaatccggagcagaatgtctggcaggatatggagatatgctcatcggcgggagtgttccgatacagcgattacagggagccctggtctcatcaggtgatttttcggcgtgtggaaagaaatagtgaactgtttataccataaaacatttttggaaggatacatacagggtattcatgatgatagggattggcaagaattgcaggcggttcgatacgatacagacaactattgagggactttcagattctctgccagactatccagcataagaatacacccctcgaggatcggcggtgaattatcagccttgaaaaaaaatcgattctccttctgattgtatcatatctatctattgaaagaggttcttgttgagggtagttttcggctcaataccataactcttcctcatttctttgatgcagagatcaatcagagtagacacaaaccccgatgggacagtgcttttcatatcttcagaatcctttctatcgtattttacaccagggggaagagaacccgatctaccggggactgatggtacttcgtcatcttcatcttcatccgaatcctgaagatcacattcttcatcttcctccatgtatttctcaaaataccggtcaagcagttcatacagttctggagaaatgatctcatcgctcgtccacccttcagggtaccacctgacgaggcgatcaggttcttcagcaaagtattctattccgaacaagggcgagtcagggatgacctgaatctcctcgtaactgcaattatgatgagggaggcaatgtttacagatgagaggagtccccccttcatgataacactcatcacaaaaaaaatcggctttcgatccgcagatgtcacaatcataaggtatccgtgaatttctggcaacaacacagatagaatcatgagccggggtatatgctggctgtctctccataacaaccagatggagtaccgttggtgagaagaaattacaggtatacgtacaggtcatcccaggtctgaagaccttccccacgcgtaccttcatccccgaactgtcaggatatgaggtatactcttctccttcaatagtaaatgaacttatgtggtcatctcccatccatatatccttcaggagaaggtcgatatcttcaagggttgcatcagggagagaggaaagatacatccagtattcagggtggccttcagcggtaacctctatcagataagcagaaggttttggagatttctttttcttgtgtgatatcagatgtacctcagcagattttctggagatatcttttctgcatacgagacattgtccgggtgatgaaggtaagagagtcattcagtcaggatactgattgaatctcacagttaaaaaaccatgcacacctacgagactgtcaatctgttccaacgaatagtaacaatcaatgaccaatatttacctctaccagtttttttaaaaacgggaatttcgtatttattttagttaatcctagtaacccatcaaaagtagagagatgatctcgtgtaattcgaatcaacattgaattcttcacaccacctgaaacatacaatacagaaaaaaggtgaaatatccccattatccatgaagtattaatactgacataatcctacggaaaggatcataatgaacagagtgattcagaaatgcacattatttttcacttgaaaccgacaacccttcataataggtttaactcctaaaagattattgaaagagattttttaacttgagaaggaagttgattgaattattccatataataaaatagatatgtatacctgaaagaaagagaaagggtttaaattaatagtgaaggtgacattctcatcattccaatatgaatattcgaaaaatattctttagagcatgattattctgtggatatttgggcgtctccattcttttaactttggtatttacggtatatcgttttcctatgacctgcttcaattaccagaagcatcagtttattatcaaaaatctcaaggatggcccgatattctccagtcctcaatgaatacaagccctttgccctccctttgaggggtccaagtttctcccgaggattttcaagtagttcaagttctgcaaaagcaacctcaagagatctccgggcaaatttcggaagctgtgctaagtcacgttctgctcctttcgagatgagtaacgtgaacttactcaaatgaatctcctagatctgccatcacttctttcagtgtcttgcatcttccagtcctgaaatcttctctcgcttctgcaatcctttgaagagtctcctcgctgagcggttcatcatcaatgtcacaggcaatttcaagaagttcagcaataacccggtcatcagtcatatcagaagaacctcggaatgcaatcaacttttcatatgttgaatcgcttagggataccgtgactgtcatacaagtgtattgtttttatggaaaatatgcattcccctgagaggtgagcatgatactcataaatctcaaattcgaacaggaatgaaaagaggcagataaataggtacaatcatgaataaaaaccaggttcatatgacatatacagatatgtatgcataaataacgggagtttattatttcttacggtagacattatctgaactcctttctcaacatcaggaatgatcaccctgatttatcaatatcctgaataccggaaacaacatacctctatatatgagccagtcaacaccatcctggcgggctataaaaacaagtctggccggaatggatgctaattccctcatatctctcattcatgatctctatgccctgaataaggagaacaaagagtatttgcagggaagagtaggtggggaagcagcatatgccagtcttcgtgaaaatgcagccaaaaagataaaacatgagttctttccggaacggagatttggaaaagccagaattgccccggttaaaaaggggatagacgaatataagaaagcaaccggagaccccattggaactgctgatctgaccctccagtttatcgaacagtttgtgaaactttgccgggaatatgggggtgaggaacagtcaaaattagatgcactcagtgttgcgatgaaagaattgcttaaaattcttgagtcatgtcctgcaataattgtggttttttattattgcattttttttcgtaagtgaatttgagccattacgaaacatcggtttaccacattttgggcagattggtagatttttagaaagaaaactctattttcgaaacataactgatagagaattgactaaaaattggatttaaaatttaattatgacggtaactatttaaagtatatacggctcacacattattatatattaaatttgaaaatatatctccctatggatatcttgttttcagttactgtgatcaatcacttgttatttcgacacggccgaaaaatataatacacctaaaaaggacatataattgactaaatgttgggaaaaagcatatttttatggttatccctatttcgtcatgaggttaagatgaccaaaattataagttttcttctggttgcaatcgtgattctggcaatagtatcgtccccagtttatgcagtggtgaataaaatctcacccggtgataaggtatttttaggtgaaagtggactagacctgaccggttttattgatggaccggtaatgattgcatggtaccatgatccctgtaattatggaatcattggagggtatcgtggttgtgttcctccggaagatgaaacccccacaataataaaaaaaattgaagacccagcagacttttttgtgaaaccaattgattttgtatggtttccaggtgaatggtatctctgggacggagaaaaacatggtgatgttgttttcatcatcgaagaaccatcaatttcgataaacatctgggatagcacgaaacaaagggatattactaataaagcaattccacaaggaaattatgtcgattttcttattgaaacaaatatggatagtgtcaccaaacgggaagggtataatgaagaggatgcaccattttcaattttcataaaacttggaaaagatggagatattatttcagaactaccggggaaggacaatgcaatgatttctttattgcaactcccggttgataaaaacaagtggtattgggttggattagatgaagatcatacaaaagctgccaaaggagatggatggaatactggtgatctatcagtattacccggagaatactgggtatgggctgaatctaatctgaatggtatgattgataattacctagcaccagatggatcgacatggacttcaaaaacccaaagttcggttaaaaagataaagataaccgaggaaccaggcactgtatctaaaccaacacatactgtgggaaaaccaatatatggcgggcaaacagactaattcccggtgaaaaaattgacaatcacttggattttctcctctttttgaggattatctagcatcaacgaattcaagttctgcaaaagcaacctcaagagatctccgtgcaaatttcggaagctgtgctaagtcacgttctgctcctttcgagatgagtaacgtgaatttactcaaatgaatctcccagatctgccatcacttctttcagtgtcttgcatcttccagccctgaaatcttctctcgcttctgcaatcctttgaagagtctcctcgctgagcggttcatcatcaatgtcacaggcaatttcaagaagttcagcaataacccggtcatcagtcatatcagaagagcctcggaatgcaatcaacttttcatatgttgaatcgcttagggataccgtgactgtcatacaagtgtattgtttttatggaaaatatgcattcccgtgagaggtgagcatgatactcataaatctcaaattcgaacaggaatgaaaagaggcagagaaaatggttcaatcatgaataaaaaccaggatcatatgacatgaacaggtatgtatgcataaattacgggagtttattatttcttacggtagacattatctgaactcctttctcaacatcaggaatgatcaccctgatttatcaatatcctgaataccggaaacaacatacctctatatatgagtcagtcaaacccatcctggcgggcaattaaaacaagtctggccggaatggatgctaattccctcatatctctcattcatgatctctatgccctgaataaggagaacaaagagtatttgcagggaagagttgggggagaagcagcatatgccagtcttcgtgagaatgcagccaaaaagatcagacatgagttctttcctgaacgtggatatggaaaagccagaattgctccggttaaaaaggctattcagggttataagaaagcgaccggagaccccattggaactgctgatctgaccctccagtttatcgaacagtttgtaaaactttgccgggaatatgggggtgaggaacagtcaaaattagatgcactcagtgttgcgatgaaagaattgcttaaaattcttgagtcatgtcctgcaataattgaggtcttgaatattgaagagcgacttgccgctgcaaagaaagatgcatcctattttggattcggtattgaagataaaatatttgatcttatcgttgatatcgaggctcttgagtagagaataaccggggatcagacattcctgaacggagtgcaatgtacgtaattttcgacccacaaaatgttaggaagaaccatggagaatacttatactgctcatctccagtaaaagtcgaacgggaagggtagtattctggtattgggtcattccctatcccattcatcacggagagatgctgccagtttatccggatgtgggatgaactcatgataaaccccataatactgtgagatatcacaccgtatttgcttttcagagagtaacatacctgtccaaattatatttccctttttttatttatgactatgtgcttacttcaatcctgaaactatttcatgaatagaccagactgccaactacattattatcacaaatcaactattttttttctaactggcacatattgaaaatagtcaaaaaggacaggtgtatcgataactctcatacctgttcaatggttctacgggtattttgtgagtattcatcaatctcatctcatattgggctatctttcagcaccccaaacagtgattctattttattacacttttcttgataaatgctatccatatatgtctgttccatagattcccataaagaaacagggataatcacgccggttttctttccattctcatcaaaaatatattgaatatcagccttcttttccataggtgattatcttcgtatatcgtaatcactttctctatacacctcaaggaacggtattacttatcatccctcactccttctctcatcaccaacaacgcagccttcttttttggccagtcccggttcatccctccaaacaagaggaggagttctgccaccggaatcaccccaatctctccggtcccgtgtaacatcatcctgttctaccaccatctccggggatgaacgccctaccttcttttacctgctaataggtagagaatcaatatgaatggaaatgaaaacttgatgaaccctgaaggatgatacaatagtatgagtgagtcaatagaaattccctccccacttatggaaaagatcataaacctgaagattaggccagaagaaactccgatagatgttatctctcgtgccctggaagtcctggaagacgatgactatatcgatgaagagacagcagtagagatagaaaaggggattgaagaatacgacaggggaatctttactactgaagaaaatatggcgaaaaagatcgggctttgatgatgttctccctggcatttaccaaacatgcagagagaacattggagaaatttgaacaaaaaattagtcaaaaaatctataaaaatctataaaaatcttcagaaaataaaatctaacccatacaaatttattgaacccctgaatagaccaaaaggtgcagaaccactatataaacttcggataggagaataccgggcaataatggctataagaaacaatgaaatggtaatcctggtggtggatattggccatcgtaaaataatataccggaaatatcagtgaggattacgaaaacccccactcttcgtgcccttggtttatttcaatatatatgccggattgtaaaaaattaagtgtttttcgcatttcttgaaactattctactatttttcgataaataacgcagccttcttcttcggccagtcccggatcatccctctcacctgcctggttaggacaacatactcctcacccgatgccccggtcacgataacccggtttcctgactctgacaaggaaagaccatccggagcaatcccaccaaacagaagaagaatatcggccatcggtatcacccctatctccccggttccgtccagcatcatcctgaatgtatcaccatctccggggatgagccgtcctaccttctcgtacctgaccgggggtgtttctttgactgatgtgacggtaaaccccattatacggtccctcctgcattattccggttactgaaccgttcacgatgataacaccgctcacacaggccgatctttgtctcgtcatcgatccaggtaaccgggtgcagatgacagagatgacaccgtcccagggatcggtcggtctgtttcatcgagtggagcggcagaactccgggaagtgcccggtatgtcataacctcccgtgatactgctgtactgtaacaccgctcacatatcagccgtcttttctgtccgggtggattctttcctcctcccttctcccggtatgtcactcctttcctgccacaacagtcacagatctgatctggtattctctcagccaggtggaacatatccggatgaatatccataataccaaattttttcccctgtttttctaactctcccggcactctttctgacctatgcatgctatgcacatctatgcaccggttatgcacatcctgatgcatagatgtactcaatgatttatactcttttttcggtacatccgaacaaatcagagacttcgatggtatgtatgcattattctcaggtacacacagagaatagttctcactcggtgaatctttgtatgcactttccggagtgtgcatagatgctgatgaatccaccatttcatcgcttttatctgaaacagacttatttttatctgccgtatctatgcattccggtgtgcatagttcgtgcataggtgtgcatagatgcatagcaccatctggatcatcacctggatcaggatttggggtgccttcagcagattcatccagccagcacgtaacaccggcagaccagatctcatccatctcataatcccaggtgtagatacgtgcccgctgatacccaccatcttccctgggttctgatcgatcatagaaggagagcggagggcatttctcaagcaggccatcatgatcctcacggtttggatttccggacaggatccgtgataccgttgactgggaccgacagatgagcttttgcatctgctttacggtgaactctgttttccctgaggcacggatggcatcaaccagcatctgttcggtgctggtcattttcgtcatctgaccaccgcatgctccgttgagctgaagataaatctcccgtgccatgtcaaaatcctgtttctctgccaggatctctatcatgccaccgatatcaacccgctcacgctggtactgatacatgagggcgattgatctgacgagatcgaggagcatagtggaatttcgccgattttgtgagttcgagaaccggatactcctggcataaggaattctgaccgataccgatgcaaggtgattccagagagcccggcagattctcatctcccgtgagattgtggtgagggggtttcccggtcgtgctgcttcctcaagttcccgggcgaggaccagatcatcctgtgcctggctgtcatcgatccagacggtgagcatccgattccagacctgatcgtccccggttccttccttttttgctatccaccacaggcaccgttcgggtatcacttttgtcaggctattccggtccttgtcaagggtccggtagatgaacggttttcgaaatgaggtggtgactcctttgagtgtctcctgcagtgactgggagagtgagacatcatcaaggcagatgaccgaccctttccggagatccttctggtagaagagtgccttgtcagtgagccgtccaccaaggcagtattcctgggggataaggtccatcatggtctcaaatgcatgggactttccttttcctgattcaccggtgacgaggacatgcagtccctttgagttctctacgagtcgggatgcaagagacatgagcagacattttgcgacgatctcgtctccttcatgtgcctgtgcaaaggtatcaaggatataccggatgggatctccctcatggagtatcctgatgacgtcgtcccggacttccaaatcgtcatcggggagaatgggatcattggtattcaatgctgtcggagctggtgacggaggctcatatggcagtaatccgtctcgttctgcttttgcctgtgcccgctttcggttctgatcctttttccacagttcatagtcgtgtttcggctttttcggttcttcaaaccgctcttttagttcctgccaccgctgggagtttcccccgcaggagttgtgatgacatccggcaaatattgccccgtttgggaactggattgcatatgctccgtccttgtgggcagttgagaacgggcattcgtcaaagacaaagagccggcctgcatgatagggcttttcggtataggagaggccatggatggtgagccattgtgcaaggtcgatggacccggcgcccgatgcccatgaatgggttcttccggcgattcctgttattccaggtattgcgggtattcctgaccgatgttcgcttgatcccactggatccggtttctcgtattgtgaggccagggtcatgaggaaggggaccatgactggagtggtgttttcaggaatgctgataatctgtgcgattcggtgtggccgctccagggtatgatccccttttcttgaccgtgtgccgtagagtttccatattcgggcagggtttgcaaccgatgtatctatggttgagttctcatcggagaatttctgatccagtgcaaggagacagtctttgatgagggttccattctccggtgtaatcgggagatctatctggtagaggagatgtgccccgtttcctgagtctgcagagatgggatccggccagcccagagaggtgagatattcctttactttcgctgcttttgcgagtgctgcggtatgctcatcgtctgatgaggatatcccggccggacggaccggatcaatatcaatcggaagccaggatcgtcggatgatatctccgtctgcggtctgtggttccctctgtcctgctttctttatccggttagcacagcgggagaggaggacagggtttacctggtttatggtaacatagataccactcattcccggtgtactgtcaaggattgcagcatctctcgccagtttgtcatgatcggtgtagtacccgtaatgagttctctctcccagtgcccggagctcgatgactgacccttccgggaagaggagggagagggccagtctgatctggtcttccggcttcattgctcctcctccggctcagtcgttggttgttcatgttcagctctgaccttccagacaaaggaggaggggtgtactcccccggttttgctccagaaggggaacatctcattcatggcaagggtgatgatccgtcgccgtccgattctgctccggccaatgagtccgggataccggtcaggatggtcttctatctcgtcttctatccgctgccgtgagatgagggtgtctccggaccggagagcggcgagggctgctcttctgatttcaggctgatacctggctttcataccctggcctccctgattgctattgctccgccgggaaggattgaatacctggacttcccacctggatgatagagccagagttcagtttttccagggaccatccggtcaaggacaagtggagaggtctttgttacgtcgtcatgacaggttcttatatccggagttctggctgtccggatgatgaggcccaggacatgctcccggttccaggcaatgagatcaaagattcgatctttgccacagcaccggtcaatcaggtatccccgtgatttgagttcactgatggcaaaccatatggcacatcgtcgtgcttttgtttcagacgacatgggagcctctggttttccatgagggaaatgataataatcgtataaatctatagcttagaactgcccctgcccaaatcgttatgccggcaagctgaatgatagagcgggggtattctgtttttaatcgtcttcgtagtcgcatggttttctccataatcgtggtctggtttttatgtgcttttccggatggaatacacggttaccgatctgcccgtttatcagggtttttagacgaaagaaagaattggctgtttgtgttgtcattcgtaaatacctgagttgttccaggttctctgagagggtttgcacgtactgatacatcctgttttgcttggagtcctggagataccgggtgcagcaggagaggtatccagaagaatgccggaggaggaggatgctcccccggggcggcaacagtggtgcattattgaacgaggataaccaatcctcccatcatggttgcatgagggggtatttgaacttcaggtaaacagggtgaaagtgaaaaggggggtatgaacggagtgagcagcagggtagatccaggtgattggagagcgaattgaagtgaatttcactttcgcaaaaacgattccgatatttaagtattactggctcgggttttggaatagtgaaacggtgagtttataaacggggggacagggagcggggcagtataccgctattcgtgtactcgatccctcgtcagaaaatcaagaaaccagtattctctatccactaccgaaccaggtggaattcattatttttactgatgaaaaggcatatgaccgagaaaaagaaagagtataccatagacagggacgatatgattccgaaattccgggttgggactgatgattttaaaaagttacgcgacgaaggaggatatttcgttgacaaaaccctctttatcaaagagataatagatgggaacgaagtaaccctcattccacgtccccggcgttttggtaagaccctcaatatgacgatgctgcggtacttctttgaacgatcagaggagagccgggcctacctttttgattcctgtgctattgctgattaccctatgtatatggagcatcagggacaatatccggtaatttttttaagtttaaaggatcttaagcgtgattcctatgatcactttatcaaggcaacgaaggcggagatcgggagactatacagagaatatttgccgattagcaaatccttacctgaagcaagcagggaccggtatcttcgtatttgtcgggaggagtcaccagatcatgaactctataacagtctgaaagaactcatctctcactgttactctttttacaaaaagccggtcatcgtcctcatcgatgaatatgacacccccatgatagaagctttttccaaggggtactataatgaaatgtcggatttcatgcgatcatggcttggagcaggattaaaaccggagcagggtcaggttctctaccgtgcggtcatcaccgggattctccggatagccaaagagtccatcttttctgatctcaacaatctggatgtcgcaagcccgcttatgatcggcccctatgcagataagttcgggtttaccgaacaggaggtttccactatcctgaccgcatttgaggttgaaaatcatgccgatatcatcagggactggtataacgggtattcattcggtggtcacaccatatacaacccctggtctctcatcagttatattcaggcaattccaaacccaccatctccgaaatggctgaatacttcttcgaacgctctcgtatatgaagaacttgcatcgggggggctcgagataaaacgggatcttgaggtgttgctttccggggaggaactcagatatcctctcagtgaaaatatcacctttggagatatcgggaaaaatccggcgaatatctggagtttactctattattccgggtatctgaaggcagatgacccaaaatttgcagagtatgatccaaatcttttaacgtattctctttctattccaaaccgggagatttttcttgcgtaccggcagtttgtgaataggttatttgaaaccagaactatgagtgccgggataaaagattttatctcctattttcttgaaaataagattccttctgtccttgagcagacgctttccgatcttacccttggccttgtgagtatgtatgatgtcgcaaagcttcctgaagctgtctttcatgctttcgttcttggtctactcgcaaatcttcggaatgtgtatgagatcagatccaatgtcgaagcgggatatggcagggccgacatcctcatgatcccaaagaccgggacatattcaatcgggtacattatcgaatgtaagagtgtaaaaaaagagggagacggagagaaagcagcagcggatggtttggctcagatacgggagaaggagtatatggctgctttggtgaatgcaggggtacccctagagaagatagtaaaacttgccgttacgttgcagggaaagagggtaacggtgaaaaaagagtaaatcccaaaggaaccggaacagagttacaagtattcgatatctccgccacattcaatgccccatgaaaaattggttttctctggtcgaaaaagattttcccgtttttatgggaaatttgcggggtaatttcatccccttatcccttcattttattttggatcttccccttcaatcgtatcatatcccggtcattcttattcagtgctcatcccgtattcacggactccagtgcttcggaataccttgagagttcgtagaggatatcagcccgaaccttccagacctctgcatcatcaggtgtcatggtgattatcagatcaaataattcgagagattcttcatagtctccctgagagatcaacagatcagcaagtctcatatagacctcgggatcttccaatccgagttctattgaacggaaatatgcctcaattgccttttctgattcaccgatcatctcgtagcaatccccaagattatcccagattgcaggttcttctggatttaattcaatctccctccagaacatatgcctttccgagaaaacaggagaaatgtgggttgtgaggatgctcctttgcaccagaggagaggatctctattgcctttttaatctctccgatctctagtgcaaaaatccccggtaatattttcctccctcctgattctgctcctcttttgtgagggatgatagaacttttttggcttcctcatattttccatgccttgaaaccatctcaactgtttcaataccccttatttcagaggttttgagaagaaaaatgatcctattactacaggcctcgacttcatcccatatccccagattatgaaggcagataagcctctgctcaagaatttttatattatcaggatctttttcaagaaccatgtcaatacaagtcatgagatcagatggtgcgagtatatgactcaatgcttcaaggtatgaaggaatattctggccgctattcccttttaatccgaaaaccttctcaaatgcgaaaaccgcaattattgaccatttttagttttttcaatctggtcaaaccataaaagaggttcttcaaacggggttatacctttccagagctactattgctctatgaagactctttgaatgcaaccgtgcgatgtggggatcccaatatcttgcaacaaaattacataataccagattgtatccctttccaatctttgctgacgttcctatctctgggaggatctcctcttgaattattttaggagctgttttttttatcattgtgaacaaaaactttttcccatcttctgtagcatcggccccatttggaatagtatactggcaacgaaattgttttggaaaattaactatatctgcgtatacccaggattctacttctggtactgcaattctgaaaattagatttggatttttatctccggtcagccatgtctggatttttaatggtgcacaaggagcggtgtcaagatctgtgagaataaaatacggcattatttttgacgcttcatggaaattatgaatcctctttttgatataaccaaagccatttcccggaaaaaaagtgccgggataaaatttttccccaaacatcgccaaaatcctcagcataactgctttttgcagttcatcttcgtaaacaaggtttattgatatcattttaattagacatgaaagaactcttcgagatacgcctgtttcatactttcaggtgcagtgtattgaagaattatatcacttatgggaaaacccgattctaacaatccacgaatttctgtattgcatgaggctaatactgcctcagaactttcattgcctggttttagaattatcacttcttctgcactgatactcttatcccatataagatcggcactatgagtactgataaaaacttgtctctttctccgtgtagctttatccagttcatacataatttttggaagttcacgaactattgctgtatttagggataactcaggctcttccagtagtaaaggagaatctctgggttcaaggagtgaccatagtaagccaattaatcgaagtgtcccatcagaaaactgttcttcctgttgttttccggctctgggtctccaatgttcatatctggcttccaagtgaggtattccaaatttatcggttgtgaatgagagttctgtgagatgagggacaagaattcttaatcttttctcgatatttttaagacgtgaatttctcgtattttccggggttttcgcgaggagttccaaaaaatttcggccatacggatcatccggtagattggggccagtaaaagcctgaggatgacggattagttgcgggacaatatggaaatacctgatatcacttaaaaaggatgcaagcactctgaattttccattcgctgatgtctgctcaagatgagtttgagacaggagggtttcatcttttaggtcatcaacatcaggtctggatagaatagtctctccattttttatgacgatctcataacttacacagggatcatgctttccatgaggttgtctgttaattcccagacgatatatccagtttactggtgtttcacctggttcttcgatatgaacctctatttctatctgtgaatttgttcttgctgcaaggcatcggagtttggatataccacctctccgctccaaggcatcaaagagacttcctccttgcttggatatatcatgaagaaacctgaatacatctaaaaaattagattttcctgatgcattcggacctacaatgaacatccgggattgaaatgagatatcaacactggagaaatttttccagtttttcagtaatagacgtttaatcatcatgttataatcccaatcccttcttatacataattcattcgaaaattgattaatcctttcggcagtgaaggggttgaggaaggctctgtcatcactttttaaaatatcttgaacttcatgatataatcccgctcaccgaactgaaaatggagggcgaaatatttcggtgatatctcggtgctccaattattcccgccattcatcatgtcctaacggtgcctcgttcagttcatcccggtacgtctgccaccggggcatatgatgcgtaagaatttctcgaaaccgatcattatgccgtttttcaatcagatgagccatctcatgcaggacgatataatcaatacatcgttccggttttttgatcatctccagatttattagtattcttccggccttcgggttacaactcccccatctggtcttcattttccggacaccaaaggctttgaccgttaccccaaggtccgtttcccatttttctatacgagcagcaactatctttttgagttcatcacgataccattcggtgaggatcttttctcttctttcagcggtagatcccggacggacaaacaggatcatccctttcgacttgtggatcgatatcccctgttttcctttctcttcctgaattgagagaagatatcgttttcccaggtagtaatgactctcacgggagacatatttatgatttataccgatttcgttgggtgattgaacttatttttaaggatttaaaaggggattacaaacttggaaaaatgtttctcagaaatgagccaatggcgtttattcacatttattccatgttactacggtttattattagcagagatctgtttgcctgaattatatctacgtctcgaaaaaatgataaaggaaaatttaccccgatgttatggtcaaaagtattttaagagaaaggattagagtttttgagtgttttgaatcaaaatttatttggcaaagggaacataaacaaacgatgggataaattagagagatcactgcggcaccttgcaaaatgccgcaacataaacgaaactctctcattgaaattttctgaaattttttaggtctttatcttcggatcgatggtctaaaggagggttatgtactattagttatcgttaaaatatcagaaaatactcgtaattctctctttttttctaatgtctctttaaagtttcaataattgtagtttagaccacgataataagagatttgcacgtcggggttaaagaaatggatcagagaagtgtctctagattcaggatataatatacaatgtattacgaattattgaaaaattatgcctcaagatctggattaatctacaaagctgtcttgcatggagctctattcttcttcgatctgttcttgactcatttttgaatggagtgatcagtacgtgggagaaaagggatgaagtatacatttcacaatctatatttataagtaaattctaacgattctttgattggacttcatatatgaatactgaggcccggatggaacttctcaaagggaaaatcgttcgtgaggattttttaaaagcaagagggctcgggaatgagatccccttttggatatttgattacccgccggaagatgaacattttgtcagatattcgatacggaagattcaggaaaaactgacttctcgctctattcattatatggagatagatctgtatgaattatgtctagagatcattgagagcaaaatatcatcagataagatcaatgaatttgagaagaataaagggtcggataaattattaaaaaaattgcagattattctgaaaccagagaatttaaagaatgagattcagcagagagttgtttcagaggacgcttttgagttgatattacttaccgggataggaaaagcctggccacttataaggctccactctattctcaacaatcttcaaccggttctgggaaatattccgttattagccttttaccccggtgagtataccaattcggagttgagtcttttcaggaaattcaaagatgcaaattattaccgggcgtttcggatgattgacgaaggaactgcataaagggagatgtaatatggagccgaagattcaggatttatttatcaatgatattacacgagagattaatggtgtcatcaaggtcgatcaggaggatgatcagaatgtatttactgaacttgatgagtatgtggtcacgaaggaatcgctcaaatacattgataccttctttcagcggtatgcatcagctcttgattctcctactgataagaccggggtctggatatcaggtgatttcggatccgggaagtctcactttctgaagattctctcataccttcttgagaaccggaaggttttcggaaagagtgcacttgagttttttcagtcaaagatctctgactctgatattttaactacaatagagaagtctgtcaggaccgggacaaaggatgttatcctctttaatattgattcaaagtcaggggagacgggagagaggattgtcgatatcctaatgcgggtatttaatgagaagagagggtattttcctgatgtcttctggattgcggagctcgaagagaggcttgaagagaaggggctgtatcagaagtttaaggatgcaatagcagagatctcaggagaaccctgggaagaggtcagaacccggtattcttttgagcaggatgttattattgaagccctggatcggtgtttgtttcagagtaaggagtcctctgaacggatgtttgaatctgatgggcagaattatattctcacgccggagaagtttgcacagaaggttaaaacctattgtgaggctcgggggagagatcatcaggtggtcttcctgattgatgagattgggcagtatatcggtgataacagccagctgatgctgaacctgcagacggtagctgaggaactcgggacaatccttaagggaaaggcatggattatcgttacatcacaggctgatattgagactgccttaaaggcgatgaaaggaaaagaggtgaaacaggacttttccaaaattcaggccaggtttgatacccgtgtcagtctttccagtgcaaatgttgacgaggttatcaagaagaggatactgaagaagaaagaggagtataccgagatgctctctctcttttatgaggagaagaagaccatattaaagaatcttatctcgttctcagggggagcggagatgaagaattaccgggatggtgatgattttacctcggtgtatccgtttgttccctatcagtttatcgtcctgcagaaggtgtttgagaagatccggacgaccgggtttaccgggaaacatctggccaagggtgagcggtccatgctcaatgcatacaaggaggcagcagagcggtacgggtcttctgatcttggaactttggtgcccttttattccttttatgatacgatagagagttttcttgatcccattattaagcggacgatcacccaggcgggggataatgaacatcttgaggagtttgactgtctcctgctcaagacgctctttatgatccgccatgtacaggagttaccaaaaaatcttgataatattattgtcctttcattgtccagcgttgatgaggataagttacagcttcgggaacgggttattgcttctttgaaccggcttgaacgggagacccttattagtaagtccggtgataacttctatttcctgacgaatgaggagcaggagatcaacagggagattaaacagattgatattgaccgtcatctgattgtgcaggagatctttgatcaggtgtttacgtccaattccatctgtcagaagtcatatggcgagtataagttcaataagtcggttgatgacaaggtatcctcctcttctgatgcagatctgacgatccggtttctgactccgcttgctgatgagtatgtcagagggagcggtcagcagtctcttggcggggagaatttgagtaatattgactcgaaagatacgcttctttttatctttccggaagagagtggatttgtcgggcagattcaggggtatcttcaaattgagaaatttctaaagcagacccggtcgaaccggaatgatgagctgatgaagaaatatcttattgagaagcagcaggaagcagcgtccctgaaggaatcgtctatctctgctattcatgagggggtgaaagatgcccgggtttttgttgatggcattgaggtttccctttcgtctggaagtccgaaggaactggtacgggatggatttgagcgactcatcaaggctgtttatcataaatcccattatgtgaaccaagagtttgcgtctgattcggatgttctccgggtgctgaaatcggctgatcttacacagttcggagtgagcacgtctgaagtgaatcatctggctttacaggagatgcatgactacatcagtgtgaaggatgagaagaaggtaccggtggtgatgagtgaacttatctctcatttctccagaaagccctatggctggaaggtgatgacaatatccggtcttcttgccatgctctacaagggtgatgatatcaggctccggtatcagcgggcgtatcttgctcataatccggaggatattgccagatatatcaccagaaaggagaatttcgataagattgtcattgaactgaagaagaagacgtctgcagagattattcagaatgtgaaggcattgcttcgtgatgtctatgatatttctgctcttccggaaaaggagcaggagatctctgatctcatccggtctacccttgatgagaagaaaggggaactcgctgctgatctggcccggtattctgaagagccacggtatcctggcaggaaacgaattgagccatatctgaccatgataaaagagatcctctccatctctgatccgaccgcatttcttgagaaactgtcagaggataaggatactcttgcagatatggctcatgaggcaggtgtggcggtacagttctttgaagggaatcagaaggatatcttcaagagggtgcttgataagattgacgggtatcaccgaaactcccaatttttagatgattcggcacaggagagcctgcaggagttggaccggatcataaaggctgataatccttattctgatatcaaaaagcttcctcaactggagagtgtgattgagggatctctcgcagtatcacgtgagcggttacaggaagaactgaagaattctgctgatcagttcaaacagaagatagatagaaagttcagttattcggatgagtacaaggagtcaatagcacctctagtcagggagacgtttgatggttctgtaagccgggcactgaattcgaacgattgttctcatcttaagttggcggcatcaaatctctctaatctctatatccgggcctgtaaaactacggaagagaagattaaaaaaattatcgagaacgaaccagatattaatccggtcccggtacgatcaaaccatgtcatcaattcaaccgatttcttcaggactaatactgtcattgagaatgaggaggatcttgagcggtatctggcgggtatcagggtgaagcttcgggagatactcaaagataagaacatcgaggtgatctgatcgtggataaggcaaagatacaacttttttctgattctctccggaagaacctccttgaagagacgaagaagcgggctgctcattatgggattacggggaaagcaatagcaacggtggagcaggagtttgaggattcgatcatcatcggcggagaggtctatccccggagtattcgggatcagcgggcgtatttagtcaaagaaatcgagaagaaagggtacgaccgggtgatggaggaggttacctatacctggtttaaccggtttgttgccatccggttcatggaggtgaatgattacctgccggttcgggtcttctcctcaacctcatccgggaagactgatcctgatattctgacaaaggctctggatctcaccttcctggatatcgatcgggagcatgtcctggatctgaagtcggatggccggcatgaggaactctttcggtatctcttccttcggctgtgtaattatctgcatacaacgatgccgtttctttttgaaccaattcaggattattctgagctgctcttccctgaccggctgctccataccgactccatgctcagagatctgaatactatcatccccgaggatgactggagggagacggagatcatcggctggatataccaggattatatcgccgagaagaaggatgtcctgattaaagcgaagaaacagtacacggcagaccagattccggcagtgacccagctctttacgcccaagtggattgttcagtatatggttgagaactcccttggccggctctggatgctgaatcgcccccactcacggctatatgagcggatggagtattacatccggccggatgagcaggagaccgattttctgaagatttcatctccggaagagctgaaggtctgtgatcctgcctgtggttcagggcatattcttgtttatgcctttgacctgctctatgagatctacaaggaagaggggtacctggagcaggagatcccggagtttattctgacccataatttatatgggatcgagatagacaaacgggcgggatctcttgcagcattcgcattggtgatgaaagcgaggaggatggataagaagttctttgatcacccggttcagcctcatatctgtgttcttgagaatatcgagctggatgaagaggatattgattcgtacatatctgccgtggggagtaatctctttccgaccggcctgaaagagactctcatgcagtttacggaggcggagaacttcggatcgctcatccggccaatggtcggtgatgtaacggatatcagaaaaattctggcggagaagaatatgtcctcaaatctgctcctgtttgatacgcatcagaaagttctgaaagttttggaacagactgagtatttacagcccagatatcatgtggtaattgcaaacccgccgtatatgggcaataaagggatgaataatcagcttcgtgattatgcaaaaaaattctacccgaatagcaaatcagatctttttgcgatgtttatcgaaagagggtttgatcttcttgtccatcagggatatagtgcaatggttaccatgcaaagttggatgttcttgtcttcatatgaaaaaatgaggcagaatattcttgacaatgctacaattatttgcatgtctcatatggcgaatggagtgatgggtattgcatttggaacggctgctaccgtatggtgcaatgcatacattaaggactataagggttacttctgttatgtagagtatgaaaacatcggttctgatggaaaacccatatcatttccaccatacaatgagagaaacaaaggtgcaggcctttcaataacgggggcataaccatcctctcaccacaagatcttctcacccagccggaaggaaaaacccttgagttcaagagggatctctcctctccaaagaatattctcaagacgatcgtagcctttgccaataccgcaggcggcggattattatcggcgtagaggataccacccggacggtcacgggtattgctgatccattcggtgaggaagagcgactctgcagtctgattgccgattcaatcgtcccccggcttgtccctgatgtggatctcatctccatcgaagatcagacacttctcatggtccaggtgtacccgagtggacaacggccccatttcctcaaaaaagaaggcccggtggaaggagtgtatgtcaggcttgggtcaaccaaccggaaggctgaccgggaactcattgccgaactgaataggtcctgttcagggatctcgtttgatgagatgccaatgcccgagctctctctagatgcccttttcctggatttgaaaccctttaacaaaattcatattctttccatactgaattaatataccatggataatcggctgcctcatccacctctccaggaagtgatttttgaattaaaatggagattggattcaattcagcccgggtttttgaaagacccacattatcaaattcttattggcaccctttatggaaaattacgtgaattagggtactcatttcatgaaccccttcaaacatcaaatattccagatgaaatggttccttatatcgttcaacatcgattcagaccatctaaagaacaatggcctcttgttcagataggatctggaattttgactcttaatgacacgactcattattcatggcctgatttttccaagcggatccgagatctggtagaaaatttttttcgtgtctatcctgaacttgattcattacagatcttagagatgaaccttcgatatatcgatgcggttactatacctgaaggaactgaccctaaagagtatctaaaacagtctgtgggggctgatattgtaatgcctgaagcattgtttattaataccggagtaatgaacaggccggttggatttgatatatatcagacatttcctcgggaaggagatggaactttggtaatgatccgatatatctatgggcatggaacaccaccgggcaaattcacctgggaaactaccgttcacattgaaggagaaacagttccaaaaacgcctgagaaaatcattcaatggtgtaatcaggcccatgatcttacgcatgactggtttttgaaaatgtgttcagatgaattaatggagtcatttagatgacacctgcaataattcacgaaacttcagtacatgactattatcctcaaccctggagagaaaatagttcagttttttcgaaaatatcaatgcaaagaccaaaagcatttgaaggaaagcgagatgtaccaatagaaattacctcgttttttgggtattcttcaattacgtcaataaaagttactagtggcactcatagtacatcctatattcaatccatcattgatcgagtgaaaacagattccaaatcaacgatcatgtatttctttcagaaaaatcctgaaatgatcagtggggttgatgaagtaattcggagaattgatagaattttccctgataacactcaatatttcttagagacaagaatggatcctgattcgggaattgattacatcagactgtgtgtcaggctttcacattaccctgatgatttttttgatattgcttttgagattgaggagtcttgttcttatcttttttcaggaagtaaaagcaaatttcttctaactactgactttatgccttcacagtaatatgcaaactcaatcctcctcatttgactgggaagaatatattgaattagcgaagcaattacaacaaaatcctattccaaatgctctatatcatactgctctgtatcgggccattgtaagcagagcatactatggtgcatttatgtattcacgaaggagggctgaaagaatcataggagctttttcaggtgttaatatccacgaacaagtgattgattattatagtaattctgaatcaaaaaatcaccgaaaagcaggaacctttctaaaagtattgaaagataaacgggttgaatgcgactattttgatcaccttacggaagatccaaaaaggatggctgatatatcaataaaactcgcagatactataattaatctcattctgtgactgaaatgcacttccaaacctcatacagtcggaccaggataagagatatgcatgaagcaatctttaacttcttagaaataaaaaggaaggatgtctggagtattccgctcacgatgcttcaggaggtcatcatcaatgctcttgtccatgcagattattcacagataggagtaccgatacggttgtcattctttgatgaccggattgaggtggaaaatcccggcattctcctccctggtatgacgattgaggatgtgaagtccggggtgtcgaagatccggaaccgggtgattgcccgggtgtttcgggagttagatctgattgaacagtgggggagcgggtttcgccggatacttcaagaggcttcggatttggagcttaccgaaccggtgatcgaggagatcgggatgcgggtccgggtgagagtttttctctctgaagaactggtgattcataccgagggactaagtagggaccaagttgggaccaagtcgggactcagtccttccggcagggaccaggttgatctgaatgatgagcagcgaatggtcttgcagaaatgcattcaggagtccggaattacagacctgatggcggtggtacagagaaccaaccggagtacgttcagagaagcggtgatcaatccgttgctggataaggagctgctggagatgacgataccagataaaccaaacagcagtaagcagaagtaccggattaccccgaaaggaaaggatcttctggcaattatatgaaaataaaggaaaaaagtgtatgaatattattccctctcatgaattcatcacccaccgggtagcgaattcaatgtgtcatcaggattccggactgatggacaggtatgtctggatgtctgatagtctgaccttcgatcatatcctttttactgaaaataactatgcagatcgaagatattcgatactacatgaacaaaaacagatctttgcatcgggggatatactgtatcttcaacctgaaaaactggggctgaatatcctcatggagcgaaggctgatagaagagggaatatcatgagaaatgacaggatcaggtcagggtttggatgtgtgtaagaggaaaagatatggtagatacgaagagtaataatccggttccgaatttttatcgggcatcggcagaggattttaagaagattccgggaagtcctattgcttggtactggcctcctttagaactgaacatggtagtttaaaaactcactccaattccaaagatgatcagtaatactttctaacattgctggagacttgtgactactttttacttcgataaaattatgcacaaattgaaagatatttagcgctgaaatgaatctattgagtttttttgaaaaagaggcagttttccttccaaaacggctcaatcgttgtctgattttattattgtagccctcaatgactgaggtagagattgctttactatctggatttcccataattttctctcgaatgacataaacaagtttattcttctcttttactttgatcacctgaccataatccaagcatggctcacaatataattcaggtaaacaaatgctatattggacgtttccatcagtaaaaatcgatattttgttttctggcgttggaagttccattcggttaaaaaatcgaactaacatatctgcacaagtatcaatatttctttttccagattcaaatgctaaaaataatccagaatcccttttaaaacaagtataggaccaacaatcacctaattcttcagagtcagttgttaggagattcttgtttttttttgaacaaactcccaaatttcatccatctcacaatcccccgcggaaatgtcatgaataaaataatcgttgagtttttcagcatgttcaccgattaagtgataatatcgagatatagtgtcgcgatggtgtccggtaactcgagatactcctcgaattgaagttttttcagtcgagtgtttcgcaattatgagaacagcagttcgtggtaaacgagaatcatacagaggagtatttttagtttcaataaaaaaacgtcgacagtgatggcaatagtactgttgattgcctgcagaattatgcccatttttagtaatattctttccatcttcaatttgaaaataagtacaatccggattttgacacgtaatcaatataggaccacgttttccaaccatgaaaataattatatctaaacttatattaatttttagtacataaaatttaatactttatttgcacttagtattaccagcttgctaacagggcactacctattgcttattgggtaaccgatagagtaagagaaatatttactcaatccgttccattatttgatatttcaagcgtagtctgtggtatgacaacaggagataacaatattttcgttcgaaattggtttgaagtttgtgataataaatgcgggtggggaatctctaacccagaggaagcaattgtttctggaaaaaagtggtttccatataataagggtggagaatttcgtaaatggtatggaaataatacgcatttagtaaattgggagaatgatggttcagaaatagtaaaatcgggtcgagcatatccaagatcacgccatctatattttaaagagaatattacctggacctttattagttcctcgaaatttggagttcgaatttcaaataaaggatatatttttgatatgagtggatgttgtgcatttcccaaaaaaaatagtcaatattttccgattgttggttttttatgcacaaaaattacctttgatttattaatgacaatgaatcctacattaaattttcaagtaggaaatgtaggtgttttaccttggttagaggaaaaaattagcatttttagtgataaaatcacatcaacggtgaaaaaaatcattactatctctcgtcaagactgggactcatacgaaacctcctgggacttcaccaccctccccctcatctcccccgaatacctctctccgaccatcgaagcctcctaccagaaactccgctcccattggcaggagatgaccaccgagatgaaagaactcgaagaggagaacaataaaatatttatcgaagcctatggcctgcaggacgaactcacccctgacgtccccctctccgagatcaccctcacctgcaacccccattaccggtatgacgccagtaaaccggaagaggaactcgaagccctcctccgaaccgataccatcaaagagctcatctcctatgccgtcgggtgcatgttcgggcggtactcactggacaaaccaggccttatcctcgcaaaccagggagagaccgtcgaggattacctgaaacaggtaccacaccccacattcagacctgacgatgacaacatcatcccggtccttgatgacgaatacttccctgatgacatcgtaggcagattcaaaaatttccttaagatcgtatttggagagaagaccctctcccagaaccttgattacatcgcccaggcattgaccggaaagagcacaccctcaccagagaaggtcatcagggactacttcctcaaggacttctttaaagatcacgtccagcgatacaagaaacggcccatatactggatgttctcatccggaaagcaacagggattcaatgccctcatctacatgcaccggtacaataagacgacgctcgcaaagatgaggaccgattacctccttgaactcgaagcaaaactggatgcagaactcaccgctttgagtgaggacccggtgaagaacaaagcacggatatccaagatcaagaagcagatcgatgagatgaaaacgtgggatgaactcctcaacaacaaggcacttgcactcatcgagatagaccttgatgacggcgttgttgtcaattatgcaaagtttaagggactggtccgggcgatatgaactcccaggaatcaggagagaaagaccggggagagggaaattatggctattctgagtattgagaagacaaccgctgcaatcctggagaaatttaaaaccctctctgaatttgagaccagaaagatcgtcttctggtacgacggggaacagaccgccggggaagaggacctgacccatatcagagaggcactcggagagcagggcattcggatgcatatcctgaacgggaattattttgccaccaaaaaactccttgaacatgaagatatcacatcatcctacctcatctactcagcccagcctgaaccagactatgagaagaactggctattagacatccagctctactccgaacggttcgaaaacagccggatatcagatatcaaggcagagataggaatcgaaggatatgaccttgatcccttccttggagccaaccagaaattcttctcgaataagagacgtgcccttggatttaagaagttctatgaaccagcctggagagaagaggactgcatcaggggaatactcgccgttctctcgaatgcatccgccccggacgtccgtgagataataaagtcggtcctgatgggttcccttcatgaagatgagaataccctctgggaacagatagcaaagtttgacctcaccgaacggttctgggagatagtgcggaaacaattcgggtattaccaggagagcccgaccctgaaaaaattattcctaagtcttctcatcacccacatcgaccggaatgccaccctcccgctcggccacctggaacagttcgtcaatgcaaaacgacaaggaaatgaatgtgagttattcatctccggatggatgcatcacgcccgggattcagcccgatttgacagctactgcaccgacctcctgacggaacaggataaaaaactcgagaaagaactgacctccatcgtggataatgaacgaatagaaggctatctgaatcccgaagcacctgacatctttgacaagagcatcatcagaaagatagtatcaaccctctccgatggcgggcaggactatgacaagtacctctcctggatcgaagcacgaaagacaaaacactacttccatgagtttgaggacatttacgctgccctggtatctgcaataaacctcatccggctagcagagcagtgcgaagaagagaagatcctcgcagctacccctcatgaactcttccggacctatactgaccggtattatctccttgactatcagtaccggaaattctacacctcttatgacaaaaccagcgataaagacatcttaaaaacccatatccgggagattgtcgagcggcagtacctccatatcacccagaagatccagatgaaatggagtgaccttatcacggcacaagaccggaccagctggggagttgaactcatagagccccaggaacagttctataccgcccatgtagataagatcatctccagaaatgaccgtgataaagtggcggtcatcatctccgatgccatgcggtacgaggtagccgttgaactaaaagaaaacctcaataagaacacaaacggcaccattgaactcacttctatggccggatgtctcccttcatataccaaacttgggatggcggcactccttcctcataccatacttgaatttcaaaaagaacacatcctcgttgacggaatgaacgctgatggcattgaaaaccgggagaaaattctcaccaggaccaaagaggagtcgattgcactccggttcaaagagctccgtgagctcagaagagatcaagccagggaaaaaatcaggggaaagcgggtgatatatatctaccacaataagatagatgataccggagataaccagcaatccgaagatgaagtgttcaaagccgctgatgaaacaatccaggagattgaagacatggtaaaccgcctggtcaattccctgaacatcagtaacatcatcatcacggcagatcacggatttctctatacccgtaatgcccttgaagatatcgatgtcattgatgtagccggatttgacaaagatcaattcatctcctcaaacaagcggttcatcatcagcagtgaaaagaccaacctcatgaacacccatcgctttctcatggattatatctcagatgaacaaaaaacgctctatatctacacaccctatgcagatctcaggtttaaaatggccggaggcggacgaaatttcgtccatggcggattgtccttacaagagatagcaatcccggtgctcctctataaccacaacaaatccctgtcagaccttgataaaaagggtattgaatatggaaaggttggcatcaccctcatcggacagagcaggaagataacgaacaacccattcaaaattaccctgttccagaccgaaaacgtaaccgagaaacgaggacacctcaaatgcaggattgccctctatgataactccggtgccagagtcagcgatgaaaaggtcattctggccgacagaaccacagatgatccaaaccagagaaaaataaatatcaccctgaccatggacagcaaaattaaaaatggtatatacatcctgaaagccatagatgaagatgtgaaagcaacattccgcgatgtcctcgagatacccgttgaagttgatattttgatacccgatgatttttaaacgtgatgtgacatgactgacctgacacccgaaccactaccggaacagagcgatgatcctgatacagataggaagcttaacacctggtttcccggcagggtggtcagaaaagacctcaccataaaactcaaagggtccaataatgtcccggtctatgtccttgaatacctgcttggatcctattgtgccaccgatgatgaatcactcatagaagaaggagtcacaaaagtaaaacggattctggcagacaattacgtccggcctgatgaagctgaacttatcaaatccagaatcagggagaccgggtattacaccgtcattgataaaataaccgtccggctgaatgaaaagagggatgtatatgaagcagagttctcatcccttggaatcaaggagatagagattgaaccggaaacaatcagaagatatgagaaattgctcgggggtgggatctggtgcatcgtaaagatggaatatatgtccgaaggatcgcgatcaccctttgtcatcgcaagtctcaaaccgattcagatcccgaacatggatataaatgaactcatcgaccggaggaaatacttcaccaaagatgagtggatcgatatactactccggaccgtcgggatggaaccggacacccttgattatacggtaaaatggcacctgctcctgaggcttgtacccctggttgaaaataattacaacctttgtgaacttgggccgagaagcactggcaaatcccatgtatacaaagagatatccccaaattcaatcctcatctccggaggacaaaccaccgtcgcaaacctcttttacaacctaagcttacgacaggtcggacttgtcgggctctgggatgtcgttgcttttgatgaagtagccggaatcaggttcaaggacaaggatggcatccagatactcaaggattacatggcatccggttcatttgcccggggaaaagaccagatcaatgcaaatgcctcaatcgtatttgtcggaaacgtcaatgaaagtatccagtccttactcaagaccgcccatctctttgctccgttccctgatgcaatgaacaatgacagtgccttttttgaccggatacattactatctccccggttgggaagttcccaaattcagacctgaacacttcaccatgcggtatggattcatcgtggattacctggccgaatacctccgtgagatgaggaaacgttcgtttggtgacactatcttcaaatacttcagatttggcagtaacctgaaccagcgtgacaccatagccatcaagaaaacctgttccggtcttttaaaactcatctacccggatgacagtgccacaaaagaagatgttcgtgagatactggaatatgcccttgtcggacggagaagggtaaaagaacaactcaaaaaaatcgggggcattgagttttacgatgtcaacttctcttatttcgataacgaagaagggaccgagcatttcgtgacagtcccggagagcggagggagtaagttaatccccgaaggtatgaccaaaccaggtcaggtatattcagtaagtcgaaatgaagagggtaaaataggagtatataagtttgagctccaggttatacccggctctggaaaatatgaaaaatcgggtcttggatcaaatatgaaagcaaaggaatcagtccagaccgcttttcattatttcaaagccaatgcaaagtctgtaagccagagcatctccaccaaggaacgggattatcagctccatgtgcaggatctcatgggtgttgggatatcagatgaactggctcttccggctttcatcagtctctgttccggtgctcttggaaaaccggtccatgagtcgattgtcattcttgggaccttcaccatcggtggctcggtgagcactattgataatctatccgatctccttcagattgctcttgatgccggggcaaaaaaagtcctgataccgatctcatcagcaggaaagatctcggttgttccccctgacctcttcagcaaatttcagatatcattctatgaagatccagtcgatgcggtgtataaatcgattgtattgtcgtaggataaaagaaatatcaagccctatttatagaaatcagtcattggggttaggttctttgaaatatcattatctcccatacccctccggcacatcctcaaactcaccccaggtaaaccaatcacttccccccactatatcagaccaccaaagagccaggaaatacttcatgaaaaaacatttgattcatacgcgggaggtaaacccgcccgactcatcatgaacatacgggaacccaggataacttacttttttaatgctgaacccctgatcgtaaacgaaccaccgtgaagattgatccatttcggctcaacaacaccaatatgctggccacacgtacaataaacgtcatttcctctcctgatggtataatcagaggaaatccgcgaatgccagtggtgcaggagtctgccttttccaatcttctggtatcggaatagttttcttccgcaggcagcacaataaaccgtaataattcgtacccatgtaagacagctttgtagattaatccagatcttgaggcataatttttcaataattcttattacactgtatgtcttatcatgaagatagagatacttctctgatccatttctttaacccagacgcgcaaatgtctcacaatagtggtctaaactacaatcattgaaacttcaaagaggcgatagaaaaaaaagagagaattacgagtattttccggttttttaacgataactaatagtacataaccctccttcagactatcgatccgaagataaagacctacaaaatttcagaaaatttcaatgagagagtttcttttatgttgcggctttttgcaaggtgccgcagtgatttttctaatttaacccatcgtttgtttacgttccctttgccaaataaattttgattcaaaacactcaaaaactccaatcctttctctgaaaatacttttgaccataacatcggggtatattttcctttatcattttttcgagacgtagatacaatccaggaaaacagatctctgctaataataaaccgtagtaacatggaataaatgtgaataaacgccattggctcatttccgagaaacatttttccaaggtcgtaatccccttttaattccttaaaaataagttcaatcacccaacgaaatcggtataaatcataaatatcatcagccgaaaataactctttactgatatttgtgatatagaggtgccatttttcagtaagaggattccaggtacaaattaccctgaattcttgaaaaattggagttttaattttgttaatccgcttgtctccaacatgaaatgaacaaatgagatcataaactcctttttttggcattagatctaaaaaatcgtagccattaatgcttttaaaacgaatatgatcaacaattgatgttatttcagaaggtcctgaattgattgaaacaaccttaaaaacagcattgctttttattctactaacaaaaaaacctccatattgttgaattttagagaaaatttttagagaatagtatcccaggtcgtttattaggagaatattctctatttcaggtccaatttttaacatcttagagtcatgaaccctttctgttgttataattgcattttttactgaattagaaacaacactataaattgcatggatctttaatccagcagattcatcgcgagaacgtgctgcaggatgcaattcatagagttttttactaattcgaataatactgctgtcttgaactaaaatatctttgaaaccccctacaattccctttaaatgagcaggagactgatgaaccatttgatctatataatgttccatcagtgatttcagaaaatctactaattttaaattaaaccgcttcctgaaactttggttacgaattgaggttagtatctttggattatcatcaaggtcaatataatgacgatggatctcgtctaatgtgggtttcatatgactgctgactccaaaaatgagggtaaatatcaaaagaacaggatcgagtttcctttttctctgcataaatcctgtttcccgagctgtcttttcaataaaatcaaaggtaaatttttgaaatacccaagattttaggttttttagacacttagaagaaggcttcttcatattctttaggtcgcccgacggtgctcaccgtagggcggcgccgaaaatatataaaggtatcgatttgtatttgaaaatgtattcttgataagtaacactgattttggctctgttaggtatcaggccataaagctgtcatgcatgaattcgtaccaagaatattgctgtagagatgtattagtgatagtgtgttattgattgatgagggtaaaaaatcctcaaatgtttattgatagtttcaaaaatattaaaaaaacctgatttgttggaagggggttttcgttattttctataagaaagcaccgaatagactcgggattatgagaggggacgggaatttgcttttggatctgaaaagaagatttggaatatcgctgattggtttattttttcatcgattacgtgtactgtatctccagggattgattttaacatccttgtcacctttcagtaaggaatcgaaattatatggttcaaaaaaattttctttgaagatacattcaataaaaaagtggatcttgtcattgaagatggcaaaaaaaccaggataagattgaatcatacgggaaagggtatttgcatgagagatttggtcctgtagagggatttcaggctctccatttccaggatctatttataaactgaatctctatgttcaaacgtatgaaggatcagatgatcgtgagtatattcatataatatcctaaatggagggaccctaacactcctcatcccagcaagctcatattgtaagggtttaccaacgtctggattttcgatgatcttctcaacaattttttatttttacctgtaaccccttatcccggatctttttaagacaccttttgaattcttcagtgtattctatctgcatgttattcccagatactatcgagatcatccggactggaaatggaatgggtccttccggcaagaacgtcttctcttgaacgctgaatctgctccattaaatccggcgtattaagaatttcaatcgtttcaataacctcttcaaattctgattgtaatcgtttcagtcttgaaaatgcctctgaactgattatgacgggtcctggtgtggtttcgtccatattctttcctagttactgaattgatcaattgggaatttataggtaatattgaaccagatcactgcccgcatcgcgaagatcaaaactgatgctctccctatattcatttttcaaaaagccagcagagataagaatttttctcactcgtggacatcaatgaatgacatataagcatccgggcaccatcatccggagcatttgacacacccattgcaaacattcttgcaaatgaagcccttgaaacagccataaggggaaccgcctcccacgacagttcagaggatggattcaggatcaccctcaagtgccatgcagcatccggggcctggtcaataacccctttgagctcgttcgcctcagcgagctttccgatgatctgattgatcttatcccctatctccggatttcccttaagagcaaccatgtcggagaaactcccaccagaaggaacttcgattaatgccttcttatctccggcatatttatccgacacatacttgacgaagaggaggacgagcacataatctttgtattgggatgcatccatacctccccggagttcatcgcaactcttccacagtgagttataaagttctgatttttaaccattgaggaaaatttcaagttccaccataataaatatcctatatggaagtcgggaaggtagcagataatggacacatcttcatccctttaccattaagaaaaaaatataatcttaatgatggggacacgatactcctggaagaacgtgaaaatggccttttgctcataccctgctcgaaactatctgtgctcatgggtgcatataatgaagacggactattggacgatctggaaaaattaagaaaacaggaacgttctttggtatgaattatctttttgatacacatgcactcatcaccttatttcacaacgaaccaggtcatgaaatagttcaatcgatctttgaggagatagagaatggaaaggcagatggttttatttcaaccgttacactaaccgaattgaagtacctctattttaaaagatttggagaagatgagtcagaaaaacgtttacatcctatcctcacttctaatcttacaataattccggtaacaatttcaattgccctgtcggctggatccatcaaaaaagcaggtatttcgctagcagatgccattattgcgtcaactgcccgggaaattcaggctgtagttgtaactggtgacacacatttctctgaaatgggaattgagatgaaaaaatacatgtgaagcctagtcataaaccgatatataataataggtaaatacgattcatcaggtccaagggatatcatcgttatggcgttcaaaaccagaaccttgaaagaccagtttgttgacgtcaacaaaatgtttttaaatcctgtattttgtattttacctgtttcaaggcttatttcacactttccactctcagatagtgacaccatttagtatatggttgttctcctctctcataccacaacccccatccacttcagatgccccttggtggtattgtccttctcctgcaggtagatggtaagagcattcggatccgcattcgcccctttcagaataagcgatccggaccctcctgtcggatcatagatggtctgaccccgtttcgtctccgaagtaatcccgatgacctttgccatgatccgggagatctccgagggcgtgaagaagttccctttactcttccccgaatctttagaaaagttgctgatcaggtattcataggcatcaccagggggatcgtcacattccgcccggttggaaatgaaatcaagatcagggttctcgtatatcgcgatgagttttgtgaaccggtctaccttctccttccctctccccagtttgtcatcaaagttaaaatcagacttgtcatcccatacgacttcaatcattcaggtcagtccaaagctccttaaaacctcctgattgaacattccctgatgcaacattggataaagcttctttagctcgtaatgccagggcatttcgtttcctgtcccgtatcctgctctggacaactgaaataaggtactcctggtcatccattccaggttcatctatttcatcaagaataacatcacgtgctggcatatacctctatgagatcgactttactatagatgttacgtacgggatataaagcatacctgacccacttgaaatcacggggatcttattacgacgaatcggttaaaaatgaaacttagggtttttttcaacatgtccttagccattaagccctaaagaaaaccctgcccaaccgaaaggcttagccattgtgagatcggaattttccagacagatcgtgattcctgtcatcaataccctctgataacctggaacaacccaaaagctctgaactcttcatatacctttgatattttcacaccagcgttttacaaacccaaccaaacctgattcagaccatcctattcccattttttcacctcaatttttaaccacctctatcctgccatcgaccttgtatggtcacacccgtgacaggagaaaaacaatggcagattttgtcgcaaagtcaaccgtgaaatcagccgaacggattctcgcaacaccgttcgcaaacaaggaagcaatgaacaccatcatcgggaccatcctttccgataacccctggggatgtaccccatacctgtccggaggagaaaacctcccggcagtccagaagagtgcagaaaactacacagggaccgtcatatacgaaaacaatgacggaaaacaggtcggacggatcagtatccgggcaccatcatccgcagcctttgacacaaccatcgcaaacatccttgcaaacgaggccctggaaacagccataggaggaaccgcttcccatgacagttcagaagatgggtttagtgtcaccctcaagtgccatgcagcatccggggaactctacaatgtcgccttcaagcgggataaggtaaccgtctccagttttgaagcggacagcatcctttccaccatcgagacatgggcagatacggtgccggctctggcataatccccccattattttgtggtgatgacatgaaccggggatgtgcgattggatgtattctgctgctcatagccggattcgtgggtgcagactcgatatcatcaaccatcatgtgtgacggggcatcatgggtctcatcttctgtcatcggacaggggcagacctatgcagcacacctctttactaccagtattgcttcgattataagagagttacaggtaaataacgggaaggtagagaccgtcaccgttgctgattcgtctggtcctatgggaattgatgagtactccgggcaggaagcaaatcagaccccgaaaaagagcggatgtgtatttgagatttctgaaaatcggaccagaatcgaggatgagatcaggtataccgggcttatgaagtccggcctgtatacatcatcgagggatcttacctcatcagagacatcagcaacaacgatggtcaacgggaccgggttgattcttgcccgtgcatcgtcacaggaccagagcaatgagaccttctataccagtgatgttgcaggcaggctgaatatgaccgaacggattgtattcagagatgatgagtgagtattgacctgattgttgcaggaatatccattgggatcggtcttgtaaacgccggggctgttgctgggatgtacctacacatggtacgccccggaatatggtgtgtaccatccgggcaggagaggacggggaggtacggatcgatgatctgtatttaaaccgggtgaaacccttatttccgtccctttttttattcctgaagagaagtcaacaacaaaacaaccattatgattcttggattgggggattgattatctccaaaaaatctactctggaaaaatctgaatcgtttgtcacaatctttccaagcccatactgtttacatgaagctgcaataagagcatcatgaggcattaaatgataggtattcataatctgaaagatataactccctgaatgtgatggtagattgataaaaattgagaagagatcttgtaaatcatcagaatctatgctgatataaggtaatttttctcgtattctttttgatgataactgagtttgagcccttagaaaacccagaatcacttctgagtaaacaatatcattgatatatccctggataatacccatttcaactttttcaatatattctgaagcaagggagtaattaccagtgagatgatagaggaaaatatttgaatcaaaaaaggctttcatcttctatctcatcaataatcttttcaatcgagtttgaggacattattcctttcgtttttctcgtaatagtgccctgaatgattatcgttgcctttgttttatctgcgagatcgggtttttttagtggtttaaaaactccgtcctcatatatcgcttcaataatttctcccataaagcatcaggtgaatttttacatattaatatacgtatcaaagatatacaagtttcattgtaggtacaggccagatttcaggacatagtcaactgtgaaatcagccgaacggattcttgcaacgccgttcgcaaacaaggcagcaatgaacaccatcatcgggaccatcctttccgataacccctggggatgcacaccatacctgtcaggaggggagaaccatccggcagtccagaagagtgcggaaaactacaccgggaccgtcatatacgaaaacaatgacgggaaacaggtcggacggatcagtatccgggcaccgtcatccgcagcctttgacaccatcatcgcagacatccttgcaaatgaagcactggaaaccgccatagggggaactgcttcccatgacagttcagaggatgggtttagtgtcaccctcaagtgccatgcagcatccggagaactgtacaatgtcgccttcaggcgggacaaggtaacggtatccagttttgaagcggacagcatcctttccaccatcgagacatgggcagatacagtgccggctctggcataatccccccattattgtgtggtgaagacatgaaccggggatgtgcgattggatgtattctgctgctcatcgccggattagccggtgcagactcgatatcatcaaccatcatgtgtgacggggcatcatgggtctcatcttcggtcatcggacaggggcagacctatgcagcacacctctttactaccagtattgcttcgattataagagagttgcaggtaaatgacgggaaggtagaggccgtcaccgttgctgattcgtctggtcctatgggaattgatgagtactccgggcaggaagcaaatcagaccccgaaaaagagcggatgtgtatttgagatttctgaaaatcggaccagaatcgaggatgagatcaggtataccgggcttatgaagtccggcctgtatacatcatcgagggatcttacctcatcagagacatcagcaacaacgatggtcaacgggaccgggttgattcttgcccgtgcatcgtcacaggaccagagcaatgagaccttctataccagtgatgttgcaggcaggctgaatatgaccgaacggattgtattcagagatgatgagtgagtattgacctgattgttgcaggaatatccattgggatcggtcttgtaaacaccggggctgttgctgggatgtacctacacatggtacgccccggaatatggtgtgtaccgtccgggcaggagagaacggggaggtacggatcgatgatccgttttgaaccggcaaaaccctttttttgctcgatcatcatcttcggtcaagattcgtaccggaggggaacgggggaggccggaccagttcggtacggaagaatgactctgcagcctcatcgtggatgagatcatctcaaagccattatacttatcaatctcattctgtgactggattaaccccctcacctctcatgacacgaacgatcgcatacatccattgctatactccaagagtctgctgcccgtacctgaacacctgctgctcctcacatataaagagcggagtctgcgacagggcgtaccggggagacgtctgcacccactgaaccggcccgataaatggctgaagagtccggataacataattcaccctcaccgacagaagaactgcggcccccctctttcgggaataattcttacagacctctccaaaggctctaatccgatcaggatcatccataaaccattcatcacagtactcaatgaggagcagagaacctttcgcccctgaaatatatgccatcaggtcatcaaaccccaaaaccagtacatatgagatatgccggtcagggtgttccttcagtaatctggtccctgagttcccgtgcaggtatacgaccgatctgaatgcccctgctgcatccggaagcgctgcctgaataacgtctcggggagcgatgtagacggaaaattcccacggggcaagcgttgtcagataggatggcagcgatatcatactctgatggtcggcatgatgaccatataaacttcaggggtgcagggtgaaagtgaaaatgtttctgaaatacccataaaaacgtttagaaagaaaaaaaagatgaaattgtcagatatctcccatggccagggagatgccctttctgatatgttcaagaccctcttcatgcctgcctgtcttccggagggtcattcccttattataccatgcctcagcattgtggggatcgcactcaagagcggattcataacacctgatcgcctcagaataattccccatcaggtccagaacattcgcttttgaatgtaatgcccgaacatttgccggatcttccttaataaccttgtcatacaggttcagggcaagctgataatcccctgccatcttacagttctgtgcatcacgaagagcacactcgatatttggattcagtttcgtaaacgtcctttcttgtgatacgatagcatctattgccattgtcaatccctcttctcctggttccatgaccactgtcccaaaaaagtgccagccacacatctggcctggtaccctcctgttctcctggagttctctctcccagggtcctgcaggagagcaggatggtatccatatttctgggatgaatgaccatggaactcgcgatacgttaagaatttgccaatcaattgcgcaaaacagatctgcacatcaccgttgcattcagtaatgccatgcaataccatggcaagggaacagaagcactataggggatatggtaaagcatacgagaaggacgaagaaaaacgggagatttggagacacataaggaacacccaatcatagcgtaggcatatggtctcaaaaaccctgacctccatatatcaaactatatatcaccgaaggatgtatagggtactctgtctgatatgcctgaaaagccaatccgggtgctccatgttgatgatcagcgtctgtggagatcaacagtttcagattatctcaccctttttggagattatgagataacctctgcagaatccggagaacaggcccttgacttactgcgcacgaacccttttgatatcatcatatcagattatcagatgccggagatgaatggcattgaatttttgcacctggttcgaaagcgtggaacatcaacacccttcatctttctcagcggaatcaggcaggaagatatcgaaggggatgcaaaagagtctggtgccgatttttacgtgatgaagaccggtgatccatccattgtcttttcagttctgagtgaaaagatacatcaggccattacccggtatacaaccgttcaggctgtcatgaatacccagatggaagattccgtgccatcttcatttctctgaataacaccctcctatgaggagaaggtgattgatatactctgccgggaagtaccacggacacaggaaaaactcccgatccttggattcgggtgtatgcgatttgttgaaaagaatggttccatcgatgaggaacggtcaaaagccctgcttcggtatgcaatagacaaaggcatcactcatcttgacaccgcctggatctaccatcacggacagtcggaatcatttcttggcagggcccttgcagacgggtaccgggagaaggtaaccatttcaacaaaacttccacattggctggtaaaatccagggaggatatggatttctttttaaatacacagctaaaccggctcaatacgaattatatcgactattatctcatccattccataggacgggagagctgggaccggatgaaggcatgtggggttttggagttccttgatacggcaaaagcagatggacggatcaaacataccggattttcattccatgaagatacaaagacctttaaagagatcgtggatgcatacccctgggattgctgtctgattcagtacaatatcatcgatgagttcagtcaggcagggcgggagggcctgacatatgcagcacaaaagggcctggcagtctttatcatggaacccctgcgtggcggaaaacttgcaaggagtccccccggtgagatcgcacatatatgggaacaggctccggtaaagcggactatggcagaatgggcgctccggtggctctgggatcagcctgaaatcaccatggtcctgtcggggatgaatgattttgcacaggtggatgagaactgccggactgcagagaccgcgtatccgggaagtctgactgcagaggagcaaagtgtcatcaggagggtcagcgatacctggcattcgctgatgaaagtgccctgcaccggatgtcagtactgcatgccctgtccgtttggggtaaatattccctcctgctttgagatgtacaacaatctcttcatgttcggggatacctggcgaactaatgccgtgtatgctgcccgtctgggtggggttatgagcggatattcggttgcatctgcctgtgtcgggtgcggggcatgtctttctgcctgtccccaggggattcatatcccggagagactcaaagaggtatcagaccggcttgaaggtccgttctttcaggtgcttgtcctgggagcgaagattgcccttcccatcatgcgacggttcgcattcctgaaaaacagtaaatggatgaattgttgatgtcctgaaaacgattaaatgtaaactttttttaagtcttatctgacaagaatatcatggtccgatgcttcaaaaaccatgagataaacctgacatactcctcagtagggtccggagggcggggagcaatcatgtttcagagaattcctaacaatatacgcaggtgtgtataagaatataaaggattatacccaagtaggtacttgttgatagcatattcgttcaggggggccggccggcagaccctgctgaattaccaagtgatttcataagatgagagaaaatgccgggtttttcggtggggatggagcgcttcggaaggagtatgtccataccggtttcatgcagacaggtggtttagatggttctggcagcaacacaaacggcaggggtaacaacaaatgagcatggaaacgaggaggttcaggtcgtcgagttcatcattggtgacgacaagtttgcagtcaacctctttgatgtcaaggagattgtcgaagcatccaagataacaccactccctcatgcaccggcatacatcaggggaattatcgacctcagaggggagatcacaactattgtggaccttcgccagctcctgaagattacaaaaggaaaatccggagataccgaagacctccggttcattgttcttgatgagtcggtaactgacggaaagaccggggttgtagtggatgaagtcacctcggttctgaccgtgaatgtggccgatatcgatcagacctctcatggggccggtgaagactctcatatcctcggtgtcattaagaaggatgttggtgagaaaggagagagtaagaaagaactggtcatctggattgacatgagcgggcttatcagggaagcggggggaatttcccaatcctgatttagatactgattcagattttctccggaattttcaacttttttaacagagtatccgtagcaagtgccccggttgagaacgcggcctgcaggttgtacccgccgcagtctccgtcaatatcaagaacctcgccgatacagtacagacccggtaggattcgggactccatgctctcttttctcacctcatcaagggacactcctccccgtgagaccatcgcttcattctctccgcccggtttcatctcctgaaccgggtattcaagtagcattggtatcagccggtttctcatctccttaggaaattgcgcacaggtcatatcagggggaacttctgccagttccatgatcaatctcacaaaccggtctggaagcggaatgctggttaggatggtctttacctgtttcaccccgcctgatgagaaacgggaaatcaggccctccctggcggaattgatattcgtatactgaatgaatgagaccctgagctcatccccggccctgaaatatctggacatatcaaggattccaggcccggaaaatcccgtgtgagtgataagaagatctcctcgtgcttcatgaaccttcttcttctcccggtacagagtgagcggtacctgagagaaggatataccggaaaggtcccggaagggaaaattctgagtatggatcggtgtcagggcaggacctggttctgcaatcgtatgcccgagagcctgtgcaagggtatagccgtcaccggtggatcccgttacaggataggtatatcccccggttgcgagcacaactccggtactatgataggtatctgtccgggtggtaaccgtaaatccggagatgtcatgactgatggtatgcaccggctcgctggtatggatgatgacaccggcctcattcgcttctttgagcaggacattgaggatatcccgggcctttcctgattcaggaaaatacttaccattcccgtcatcacgaaacggcactccccggtcctggaaaaagctgatgagcttgacatttgagaagtgcatcagggcaggtctgataaatctcccatgatccccgtaatgggatgtgaattcagatatcggtccggtatgggtaaggttacattgacctgaaccggataggagaagttttctcccgcaggttggcatcttttcgaggagaagggtcttgcaccccccttttcctaaaaggagagagcagaaaagtcctgccggccctcccccgatgacgatgacggcatactgattcatgcacgtatcctggagataaaggggattatatcaggagcggtgaaccacggcatcccggaaacagggttcaggattatatctccccgaatttgaagttatcaaaggcgacatggaccggctgttctttgataaatccctgttctgccaggcgggatacaaagaacccgatatccccgtgggtaagggatgtgtcagaaatggccctgaccatcttcccgttgatatagaggctcagcgtatttccttcagccttgatcccgagccggttggtttcataccccttattcagaatataggtctcggtcaggggaatcatctcatacacctttccgtccatgtgtttcctgaccgtgaaccagccacggccattgattccgaatgagtagtagttcccgttatcaaaccggaagatcatcccgtactgaccggtgagcgggcctgaatcaagccgcgtttctacctctgcaacgaaatctgtgacatcctttccgagaagggcacggtcggagaggtcctctcccttctggatcatgtgatactctcccccggagtaatacttcaggaacgtatcactttcatacgatccccacccgctctctttatctgaaaagttgtcaaactgggtgtatccggtccctgactgaacatctggtgtcggctttggagtctcgattatttccctggttacttcaggcgtaatctccggaacctggactgatgtctggtcaggaggggtggatggcagaaagaacaccgccaggataaggatgattcccacaccgattatccctgcaagaaaagccatatcccggtttgccggtagcggaatctgcatccgttttcttccggcaggctcttcgaactctgcatcaggctccagtaccggtcctttcagtggttttgcttttggttgtggcttttctgggatgatatcatctgagaagagatcatcatacggagatatcggttctacgtgtggtgcgggtttatcatctattggcatggcacaatatgcacaggtccgggcatccggtctgttctcttttccacatgacgggcaggaaaccttcttcattctctcactccgataatgcccggtgttacggcattctgcataaatggcaggtcaatggttcttccctttcctattgcgaggtgggctgctgcaagatcggtaatagacagcccggttgagtcaaaaaccgtgactgtgccaggggagggttttgggatcgacccggtcagcaccttcccaagcgttccggttatctgcgagggggtatatatcccctcactgattggcacattcacctctccggaatggatggcctggtccatgtcatccacgaacacatccgctctttttagtattgcgggatcaagttcctgttttcctggagcatcggcccccatggcattgatatgagccccgtcagagatccactcatccagaatgatcgggattttcgaaggggttacggtcagaaggacatcggcccctgcagcggtttcaatatcggtgggtcgtatagggagatgagaataccgctgtgcaaacttctctgcatgagaggctgacctggaccataccagcacttcttccggttcaaagacatgggagagggccagaagaccggaatcagcctgcctgcctgatccaataatcccaagggtcccggatgttttgtgagccagagccctggttgcaacagctgcagaagctccggtccgaaggtcagtgagtgtggttgcattcagaactgcaacaggcattccggtcggggggtccagaagtatcgtgaccgccatcacggttggcagacctgccttcctgttttcggggtggacattcacaatctttaccccggctgtctgaagggatggaatatatgatggcattgttctgaaatcaccccccggaagatttacatagaccttcgggggcataatgctccttcccgcaccgtgatcaataaatgcagattcaactgcagctatcagatcactcatctctatcacctcttctggcgccggatagtactgcatattaattatttctcctctttctgccctttttatccggagtacccggatattttccggttatgtcaggcctgcatatatggaccaggatttccttcttagtatgcttcctatgattggttatcttttctccagcatcagtctaatgagtggaatggcaacatcggattcaacatgagtatctgaaaagtatgccacattgctcagaacaacaacgccaatcccctcgtcctttacaaatgcaatatcagccatgaaccggttggtctctccggccttcagatgggtctggggaatgccttcggtctcaaacgtgtcccagaagagcgactgccagagatcaacctcttcagtagatcggatggttcgtggatcatgtgacaaattgacggcttttctgagctcttcaggtacatccagaaacccgagctgcagggcaaggtaagctgccatgtcatccgcatcagagatgattcccgctgctggcgtccagaactcattgtacctgatgatcatcccttcgtcatggtccggggcatacccacggtatccaactgcagaacgctccaaaagctcagggttccaccctgcagcggtgcttttcatcccaagcggggtgaggatacgctcattcacgagctccggataggttctgttctggacccgtgcaacgatatctcctgcaatggccgtccctgcgtttgaatactcccagtcatcacctggagatcgcgtcagagtcaggtttgagagccatgcatataccagatctgccggtatctcctcatatcccctgaaggttgattcagcctgagtttcgattgggtcgctctccttctggtaccggtaaaaatcatcaggcacattgggaagtgctgatgtgtgggtagcgagatcggagagggtaatctccctgccctgccatgaggggacggtcaccccctccggaacataggtctgtatggggagagacaggtttatcacaccccgaagctctgcatcggcgagcaatagcccggtaaaggtctttgaaaccgatccaacctcgaaagtggttcggttgtcaggagcctgacccgtcgcacgattagccatcccaaaggtgtaaagggcagaaccgttccgatcctccaggataataacaaggcttggatatgttccattatcaacaagcggctctgcaatcgaggcaacctcctcagcggagagcgtggaaaattttcctggagcagtcatccgccactcttccggactcatgagccctgccaccggaaggcagaccaaaaggaggacgaaaaagatgggaaagaccatccttccgaagccatattcgttttgtatcatgcgatcttctcctttttccagacgatatacgaatagactacaagatatatggttcctatgatgaccggaagaaggatgaagaggtacgcatactccggtaccaggatcccaagcaggcagaggagggcgatgataagaaagacgcgaaatccgcgttcatgagtttccttccatacggtctcgctctccatggtccagggagtccgaatcccggcaaaccagtttggctttacccgacggataaaacatgcaattccccccataaggatggcgaaaagggccgatataacctggttcattggaacttcaattctcagggcccagagaatggtgatgaggaagagcagaaagaagaatatattgagcagcaggataagtgcgtcatatgctccctggaattcctggtaggcttcccatttgggatcatatctgggaagaataatcatcaagagggttatccctgccataagagctggaatgaggagggcccctgggaataccggcattgtcccgtccacctgaccctgaatattcaagtgggtaggaatttcgtccggaaggatggggtaaaccatgtatgctatcccaaaggtcaggagaatgaggattattgagagtacccgaagcagctgcatactattagttcagcgttcgggcattaggttcttttctgctctcgtaccggtccctgaagagaacatagaggtgctcatcaaggaattgtccatgtttccatattgctttggtatgtactgcttcgtgttcaaatccgcatttttcaagcaccctcatggacgacagatttgtatgaaatacacctgcctgaatcctgataatatccgtggttgcaaagactaccggcacacatgccctgactgcatcggtcacgacccctcttccctgatacttttgtgacagccagtatccaatctctgctgtccttctgtaaacatccgaaagcgggtgaataccgattcccccgacagcctccccatcaacctcaattgcgagcaggatagcgatttgttcattctgtgccattgcgatgaaccggtctgcatcatctctggaatagggggatggaaatccgtcccgcatccatcgtgcaatatccggattatttgcatgaatagaaagcgagggggcatcactgaccgaccaggtccgcaggatacaggatggtgtactgatatgcatgatggtatctccattcgcatgcagaggccctgggcttgcgttcaaaacagcgctctgcggattactacacagaagtttttcttcttcgctctcaaatattgaacgatgaacaaaccggaacaaccggttgggagatctccatgaattttaatttgataccgagtaaatttcatttctctgccagatactggtgtctgttctgcattgttggaggaattctgctcgcaggttacaatccggtatccggcgcagaggcccctgatattaccagtctttcccctgatactgtgcatgcaggattctcccacctggtcaccctgaccggacagggtttttcagaggacatgaccattcgttttgcaaaggatgattctgtcctgaatgtaacggacgtgaaaaacctctccgatacatccgtaaccttccgggtcattgtcccggctgatgcaaatcccgggctgtatcagatgatccttcagtcaccatcactgggagagcaccggtataaccaggtatttcatgtccagcctccggcagcaccggagattgtgaatatttcaccctcctctgcaatggcaggatcatcagttccactccagataaccgggagatatttccgctccggctgtacagtccacattaaccaggatacaagacagataccgcttaccaatctgtcagtaaggtatgaccagatatccggagaactcatccttccgacagatgccagacccggctcctggaacctctcaataaccaacgcagacgggcaggaagccgtcaggtcagaaggatttaccgttattgctctcccaaagcctcagatccttgccatcacgcctgaccagggtgacatggatgtcccggtgcaggtagcggtaaccggcagcaatttcctgaaaggagctaccttttccttatcaagaaatgatctcatcgtgcagggaatagaccccgttgttgattcacctggtcgtatcatcggtacggtgaaggttcctgccaggtatcatgagggcctgtgggaccttaccgttacgaatcctgatggacagtctgccagaaagaccaatgcctatctgagtggagagccatatgctccctttaacctgcagataactccggtctggggaatccagggcacagaccgtcaggttaccatcagagggatgtcattccttgaaggggatcgggtcacgttgcagcggggggaaaagaccatatctgcaaagaatatcaccatcgtttcaccaacccagatcacctgtaccatccccattccggagaatgctgagcagggggtctgggacgtggttgtaaccagccggtataacaagagtgatattctcaaaggcggtttctccatctatacgaaaacatcccttctcctgtccggtatagagccggctgccggggaacaggggcagtatcttaccgcaaccataggggggaataaccttgcaaacgggtcgtccgtcatgctgaccgcaagcggagaggaccagattcaaagcgaatcaactgcacttgtccgtcctgatgagctgaaggcctggttccatatcccgtcagatgccatgccggatctgtatgatctgacggtcatatttccgtctggtcagaagctggtaaaaaccggagctttcaggattctctataataacaccccggtcatcgagtcaattgagcctgaccgggctcaggttggaactgaggatctgaagatcaccgtaacaggtaaaaatttcggggatggagagtatctgaacctgaatcttacccataatgccacgacgataccggtatctggtgcagtgtcatacaaaggaacccggatcaccggatatctgaccattccaaacggaacctgggccggctggtatgatctggatgttaccagggatgcaggtcggggaagaagtgcaacaaaatcagagatgttcagagtcctgtaggggagtatcactggtggctcagatgatccccgtcttttttctgttcaggctggatcgaatatcgtaatacatgcagtgatatccggcccctatgtcttaaccgggaatcaggacaggctctgctccggatgagaaaaccggtacatccctttcgggacgagtatctcaaataaagcacccttctgatactccccggtctccctgatagtgatgtgggtaatggataatatctccctcgcaaggaacatgccaaggccggagttctttccataccctttctcaaagatcaaggttttctcatcaggtgaaactcccattccatcgtcagcatacctgatcaccagggtgtcatcctggatgtcatatgtacagcagatcctggtaataccttcaccatgccggattgagttatccataagattataaaagacctttctgatgagcgggtctgcgtagacctggattccgtcaagggagatagagagagagatgtcttttatgatcaactcttttgaaacattcaggatgatatcagatatctcattccactccggcttattcagcccgatatcctggtaggtccgggtgaattcaatctgctttttaattgcgttaattgctccttttcccatcttcacatactctgaagactccggatcatgctccactgcttcggcgatgagcatcataaggccctgaagcatagtgattttattcagaatatcatggcgggtgatactggagagaaggtttagttttttaaccgcctctttaaccgcttcttctgcccgatgacgttcagtcacatcaatcagtgtctcaacagcaccgattatctcaccctggtcatttttatacggggcagcaagaatgtacagccagatgccgttctctttcatctccggataataccgggtcatctcatatgccccatcgatgaggtcagacggatgacaactgtcaccatacagttcattcagaatctgaaagttccggtcaagaagagcatctacaagaaggggtcgttcagtcgggaaaaatgctttccaatggtttttcgtcccgatcatctctgatgcaggaatccctgaaaacttctcaagggcccggttccaggagatgaccgtgtgattttgatcgataacgaactggaatgccggagaactctgaagaattgcagaaagtcgcgcttcactctcccggtatgcctgttcagatattgccagtttttcgttctcttcatcctttctccggttaatggtgataaatgagaggaagatggcaacaatgagcaatgtcccgaccagaggaggaacgccggcatacagggtgatcaatgtccagtttctcgcgtcgatatcaatcccgaaaacgccgataatagtaccagtcttgggatcctgaatcggtaacaagccgctgatccaggttccccaccggtcggttgtggggcctactatcccggcctttcctgtggtaaataactcacgaacctggtcagaaacctccgtataatcctgtcctggcggggagtacccgtcggttccgggtgattcggagtcaacataaaaaaacacacccccgtcatcccgctgccccatgatatatacaaacctgctgagcggttctgcagccttgatactgaccatcttctctttcatcgagatatacgcggggttggtaagatcggcatctgaaccatgaaagttcctgatagtgtcaaggtcaattcctgctgcggcaagtctggtttctgtgaggacctgttcccgaagctgggcatccttgtggtacatgaagaccagagtcatgcatccgccgattcctatgataactgcaagtatgatgatgactcgcagatcaatccgggatatcatgatgccaccaggtatgtatgatacttcacgtaggatgatatatatctgcatgtcctaagaaaacacatggattgtggtctgtacatcattactgatgagattctggctcctggctgctcacatatacagattgcgaaagaatctctctccggcggtgcaaaaatcatccagctccgcgataagcgaagaaatgcagcagaactctatgcaattgcgcaggagatccgatcgttgtgcactcagcatcatgcccggttcatcgtgaatgatagactggacattgcgcttgcagtacaggcggatggcgtccaccttggtcaggatgatctccccctctctgccgcccggttactggctccccggcccttcatcatcggggtatcggtggggaccgttgaggaagcagtcctggctgaaaaaggaggggccgattatcttggggtaggcccggtatatccgaccggaacaaaggcagatgccggaccggccgtgggcccgggcctgattcggagtatcagggaacgggtagccattcccatcattgccatcggcggtatcaatcttacaaatgcaggcgacgtccttgctgccggtgctgacgggattgcagtcatttctgcggtgatttgtagcccggatatcgccgccgcttccagaaaatttgcagacctcatgatacattcataaactccccccgatctctccatacagtctggtgcacaaaacgtagaaatagttcaaacgagacgcaatatggatatgacgcttgatgaaatcaccattagcagggcaatcgtaaccgaccacctcaacaccctcattgagtacatggagatggatgttgccgtgatcggggccggtccgtccggtcttgtctgtgctgccctcatcgcagaaaaggggttaaaagtaggcctgattgagaagaaattatccatcggtggcgggatgtggggaggaggaatgatgtttccccgtattgtggtccagcaggaggcaaaaaggctccttgaccggtttggtatcagatcatcagaattcgctccagggtactacacggccagatcagtggaagctgtcaccaaactcgccgctgcagcatcggatgcaggggttgaatttttcaatctgacgacggttgaggatgtcatgatcaagggagatggaactctgtcaggtctggtgatcaactggcagccggtggaagcgaccggacttcatgtggatccgctcaccattgggtgtaaaatgactgttgatgcgacaggtcatgatgcggtaatagcccggcaggtgtcgaaaaagtgtggaaaacctgatattaagggagaagggaccatgtgggcagataatgcggagtctgccgtggtcgctcataccaaagagatatttcccggtcttttcgtatgtgggatggcggcaaacgcggtctttggcggtcaccggatgggtccggtctttggcggaatgctcctctccggtgaggcagcagcagagcagatcctcaaaaggttctgatatttcattttttttcaaatggatttaacgaatcaaatatacagtctatctcaaccacatatggcttgatgtctagaaccggggatccatccagagcctctaggccggttaccgtgatgatccccttttctatctcttctatccttccgattgagagtgcaatcgggtttggccgtgcaggtgaccggatggtaaacacaggccggggttcatcccagtctggccgttttgcaaagaggatatcccgttctgcccgatccatccagtataacacccagatatgggatatcccctccatggttccaagaccggggacgaactgaggatagatctcgattttcatcggttcagagcaggatcgcccctgccgtggtgctgatccccggctggtaaatggtgaatggataacgccgattggttccagttctatcatggttttctctcctgtacctctgtgcatcgatccatgattacccgaacgggttcagtacgagtatcatcccgttcaggagggttgcaaatacggtccagcacaggtagggaaccagaagccagactgccgttcgcgatacctgtctgaaatgatgtatggtcaggagtatcaggaggataagagctaatatgacgacaaagcccccggctactgactgcattccgaagaagacaaccgaccagagcagattgacgccaagctggagaagaaaccagaccgttgcagtcttcacggttcgtttttcaaacccgtgtttgagaacaagccaccatgccagtcccatcagaatgtacagaatggtccaggcaggtccaaacacccagttcggggggctgaaccagggtttttgcaacgtcaggtaccagccagttatatgtgccatggtaaaggaggaaccgatgaatccgatgatgagaggaagagcaatacagaagataaagaggagagccatgactatcgggcggaatttcatgatagtatggtatcggtcttttatatgttgaatatggcggtcgggaaaccaaagattccgatacctacttaaactctcatagcatgtattactgtcactggcaggattcagaggaatttttgtcacaccgactagtgcgaacgtattgccctaaaatttgtataataaccctgacaggtttttcgtgatgtttttgcactttttaccggagatggtcagataacagaattagatctacaaccagatattgcatcgaattcacaaacacctggagaagcagatagtgaaaccatcagggtccgtctgcccaatagcaggaaaggagaacagtttgcctatgctgaactgatgctgggctcatttcatatacgggtgcggtgttctgatggcgtgaccaggcttggcagaatcaaagggaagatgaaacgccgtgcctggattcgtgaaggcgatgtcattatcattacaccctggtcattccaggatgaaaagtgcgatatctcataccggtatacccctcctcagcgtgactggttgagacggaacaagtatatctaatattctcttccgatttctttttcactctcatttttgcatcgtccggtattatcagccgggagagagcaaaggtatttaatcttataaaaaaagggtaaagtatgtctccacgggttattgatccagctcctgcccggagataccgggagaagcaaggcagaataagtaaggaccgggcgcgttatctggagacgctccgtcatcatcccatggcaacgccctatccgcatcctgcacgaaaagcctggaggaaacgttccgaaccagggccatggcatactactcacagtcatccccatcaggaagaactcggccctcacaccaaccagcctggcccgatccggtttccggtggccattatcctgaagggaaaaagagcgtaagaccaaagggcatcatttttttcggttctgaaaggaacgttccggacaggtccatgactgacaatctttttcaggatatccaatcagcggggataagaattgctccccatgtgatcaggacgccgctcatctattcatccacattctcccggataacgaatgcccatgtgtatcttaaacttgaaacgctgcagaaggccggatcgtttaagattcggggcgctatgaacaagatcctcattcatgcgaacaaggcaggaccagcgggagtggtcacggcatcagccggtaatcatgcccagggcgtgtctgttgctgcccagatagccggcattcctgcaaccgtcattatgccgttctggtcttccctttcaaaacaggaggcatcacgaggatatggggctgatgttcacctgttcggaaaaacccttgaagagtcgatgcagcgggcgagggaactggcagatgaagggatgctatatgtccacccgtttgatgatccggagattattgcaggtcagggaacgatagggcttgagatctgcgacgctcttccttcacctgatatcgtcgtagtgccggtcggtggggggggtctgatctccggcatcagtgtggcggtaaaaaacaaagtgccgtcatgccggattatcggggttcaggtgcaggcatgtccctcagcatatcaggcaaaatatgggggaggtgaggtgagtgaaacaaccggatggaccctcgcagatggaatccgggtaaccagaaccggtacacacagtcttccatacattcgtgatatggttgatcagatcgtccttgttgatgatggggagatctcggatgccatgctgtggctccttgagcgaaagaagattgttgccgaaggagccggaacgacccctcttgcagcactcctgtctcagaaattttcattctctcccggcagcaccatcgttcttgtcatcagtggaggaaatatcgacagccatcagctgtccagggtgatcaggcaggcccttgccagacggggcagactgatgcggcttagtcttgttattgaggatcaacccggctcccttgcagaagtgctggctatcatcgcacgggaaggagggaacatcctgaagatcagccatagtgagtgggatattgaactcccggttcatgaaaagagaatatggatagagatagaaacccgggggccttcacacattgcagcgatagaaaaagtcctgtcgaatgtgggcattcaaacatccggtttttctgatgagatgactggaaaataatatttcaagccttttcaggctgatattgccatccgaatcgccagcaggataagcattccgataaaaagtacctgtaacttcttctctgacatggtgctccctgtcttcaccccaaacctgacagcaggaattgaggtaaggaccaggaccaggacaaacaggaggtttacatacccgatagagaagggaaaaagaccggtcactccccatccaagaacgatataggagaccaccgttcctgacgcaataaggaccatggcggtaagcgagatacctatggatttgtggatattcattcccagaattgatgtcagtaccggtgtcagaattacgccgccaccaatcccaaagagcccggatgcaactcccacaccaatgccgaggatgaggaggatgaaatcagtctccctgacggcatatgcacacagatatctgcattgtttgatgatcatccacacagccatgaagatcaaaaagccggagaatgcaaggatatgaacctgactaggaatgagaaccgagagggtgcttcctgccatcgacccgagtattcctccgaagcccagaatgagggccggccaccaggtgatctgtttcccgctgaaattttttatcgctcctgcgactgcagtcggcagaataacggcggcagaggtggccacagcaatagccatggcattatcatcatacccaaggtcatttaagagaaaaaacatgaccgggaccatcacgacccctcccccgataccaaaaagaccggcgagaaatccggcgacaaggccacagagcagaagtatgataataattacgatgaagaattccatgccatgtcagatgagttcttcacaattctggtattttctcatatcatatccacgttcaacatgagcacggattcgggcgaggagaacggtttcgtgaaaaggcttggtgatataatcggtcccgcctgcctcaaggccggtttcaatattcgtatcctcgtcttttgccgagagaaaaattaccgggacagatttgatggcgtccatcatccaaagccgtctgcagacctcaaacccatccatcccgggcatcatgatatcgagtaaaatgatatcaggcggccgctcctgtgccatctccagggcatgggggccgtcggttgaagtcataacctgagagcctgaccggtggagaacctctgcaattatatagagattattcttattgtcatcaacaatgagaacgagcacatcttcgtttctgatatattccatattctctgttgctgcctggttgcgcctgaataaaatacacacgcctctctgtatgggaatgaaccgctagatccaccagggatccctgttctcatatccagatccccggatgactatttaatggattctatctgatcatctttttaggaaatatagaaagattgagtaaaaaagaaaactgcacaagatttcactctctatgttgtttatcagggtgtaattttcaaaaatccatgtaatgcatgggtgttcagatatccacctctctccccaggtaacaggagattttatcttgttcaatgtgaaatatgcacgctgatatggctgtagatccggatgagagccggttcgatgaggggatatcgcttattaaagcgggaaagatagaagaagcgattgatatcttttctgaactggtagagaaggatgatcggaatcataaagcctggaatgcgtatggggtggctttatcccagacaatccataaagagagtgcaattcattgttttgaaaatgccctgcagttggatcctgataacaaaatctatcagcgaaatctgaacagaacaaaaaatcccccttcaaagaaaactatcagaaaaaaggctgaactgacacctcataagtccgggaaaagatggatagcccctgctgttctcctccttctggcgggagtggcagtattaatcgtatccggtctggtgccgggagtctcggtctcagatcaggtacgcagtcttattcctggatcagggccggttgaggaggtcccggtcattacaccagaaccggtcatcactcctgaagtcacacccgaaccaactcctgaaccgacaccggttcctacacccctgcctgaacctgaaaccctgttccatttcattgatgtcagtcagggtgatgcagccctgatacagagcgaaggcaaaaacatgctcattgatgccggtccgaagagctcaggtccgcgccttgttgagtatctgaaacgtcagaatgtgacctccctggattacgttgtcgcgtctcacccgtttgatgatcatatcggcgggatggttgatgttctcaaggcctttgaagtcaggacgtatgtggataacggaatgacacatacatctgacctgtacaaagacgtcataaatgccgtaatatcagatcaggcggtcaggatgatcgtcactgcaggtatgaatattccctttaccaatacgacaaaagtggatattatcgggccgcaccgtctgaccggtcaccaggatacagactcgctggtcctccgggtcaccatgaataatgtctccgtcatctttcccggtgattcatcagaagttcgagggcctgcaaccatactaaaactccctgaccatggatcagatgcaggaatcggtcctattatgaataccagacctgaagcggttgtcatctcgctggcatcgggcaatccgttcggatatccccggtctgcaacccttactgagattatgaaacagggtgcacaggtattcagaacggatgtaaatgggaccatcgttatcaggaccaatggcgaaaactggaccgcaaaaacggtacgctgatctgcatcctcattatcggagaaaagacgggaggtcttcctcttcccgccttattctatccggtattttccttcagggatcctcatgatgaattgtgctccctttccttcggttccggtctcctcaatggtaatcccggttattgcaaggatctcccgtgcaagaaacagaccaaggcccgtattcttccctacttccctcgaaaaaatatgctttttcatggacggcggaattcctaccccgtcatcctcgatgatccagctcagactatgatccggatttctgctccaggaactggtaatcctggtgactgttcctccatgtctgatagcattctccatcagattatagataacttttaagagaagcggatctgcaaggacgactaatcgtgtatcggtatcaaattctatggatacctgccgtgtattcaccagtgctgcagaattcttcaggactgccctgatatcatgccagactggttcttttgagcccagatcctgataatcgcgggtaaattcaatatggtgccggattgatcgtgctgcaacctgcgatttctgaataaatatccgtgcctcctctatactggtctctgttgcggcaaattccaggtacccggtcagagctgtcagaacattgagaatatcgtgcctggtaatggaagagagcatgttcagttttttattcgccgtaaccagtgcatcctcaatccgttttttctcagtaatatcatgaatgattgaatagaggacctgtgcctggtcaaggacgatcggcccgctgtgaacttccacctctctgatctctcctgatgcaagccggtgcctgaaataaaagaaattgcgttcttcttttctcgcccgctccatctcctgaaaaatttcatccctgctaagacagttaatcctggtaatgtccatatgggtcagttcctcatgggtatatccataataggagcatgctgcaggatttgcatcaagtatcgctccggtatcagggctgataatcagcataaccgagtggttatttgaaaagatgcttctgtaccgttcttcacttgatttcaacgccatttccgattttttctgttcagtcaggtcctgtatctgcaccagatagccgccggtaatatcaggatatgacagggaaataggcgttatctggacatggatgtcaatctgaccggtctttgtggttttgtacagcgtatgctgttgtaccagatcaaaatcgaagctggttgaatattccacacgttctcctgtctttaattgtttgagagcaccttctggaacatttgggtcctggaagagatcaaacatggcgatctctttctgatgtactacaccaaagagatcaagacaggctttattgacctggagtaattttccatcggagttaaatagttctatggcaatcggtgactgggtaaagatctcatgaaagatgatctctgcctgtttggatctgataaggggtatcagtttttcagaaagctggtaaaataaatcctttggggagtctgtctttacgaaatacaggtccgccccgctgttcagggcatcaataattacctggtcatttcccttcccggtgaggatgacaaagggaattttatttcctttacttcgaagtgacctgagaaatgtaaggccatctgttaccggcatatcaaaatcagagatgatggcatcatagtggtacttttttaagagccgctttgatttttttaccgattctgacgtagtcactttaaatggtccggttttttcaagaaacgtttttgcgattgagcagatctcaggatcatcatcaacaaagagcagagaaaaaatcatacctggcacccctcgttcatggtatcatactggatggtaaagtatgaaaccttatcttcttagcagacgatgattcaagctgtgaatgatatgaccaggcatatcggatgggtatttgttacatgtttcattcttctaatctggtgtaatgcatcagctgaaccgatttccggatggcatccctcagcccgcgattactttactgtaccaggatcaggacaggtagaaaacggaggagccgtcccgattatcccaatgccggtagagaatcgtacgacgcaacgtgagaatatttctgcgtcttcggttggatatgcatcggagggggtgaatatctctgcaccagcacgagaagcacgaatcctggtcaggtataatacctctgaagtgtccgcccttgcagatgtggagattgaaggggttgctctcacggaggacctgagctccagtctgtctggtcttgtgctgtattcaaccaggggaaagagcgaggaagaagcaataactgctctgtctgccctccccggggttctctatgccgaaccggattatatcgtatccattgaccggactccggatgatcctgaactctggcggcagtgggggattgcaaataccggtcaggtctaccgggagaatacccctgccggaaaggccggtgcagatggaaacgtgctcaatgcctggaatatgaccaccagttcaggggatgttatcgttgcggtccttgataccgggatcgactataatcatcctgacctgaaatctaatatgtggaccggctcttcaggagaacacgggtttaatgtcataacccagacacaggatccgatggatgacaacgggcatggaacccattgtgcggggatcattggtgctgtcggcaataacggggtggggggatctggtatcgcctggcagacaaaactgatggccatcaaggcaatcggagcggatggaaaggcatacacgtcagatatcatcaagggaatcgaatatgcaaccaaggccggtgcagatatcatcagttgttcttttggtggatctgatagttctcaagggttatatgatgcaatagcagaatctcctgctctctttgtatgtgcagcaggaaaccagggtaaaaacaatgatcagacacctcattacccttcatcattccagcttcccaatattatcggtgttgctgcgaccacctcatccgacacgcttgtttcgacctcaaattacgggaccacggttcatcttgccgctcccggagaggatttgtacagtacagccctttctgtgccaggtgggggacaataccggtacatgaccgggacctcacaggcgaccgcgttcgtggccgggatggcatcccttgtgaagagccttgacagcagtctctcgaatgaggagatccgatcgctcatgatatctcattcagatgccgtccctgcattacaggggaaagtcgccgcacagggacgggtgaaccttggtgctaccctcgaaagcctttcgggtgaggacgcaattcccctgcaccagggatggaactttgtatcggtgccacggccactcgcaccagggaaagacacggcgcagatatttggccaggtgagctcaggtggccattctgtccttgaatatctgcatggaaccggttggaagaccctgaaggcttcagacccaatctccatcatgaccggatactgggtgtattccacaaaggatgattcagttccgctgcagtatgcaccatcccccggtattatcagaaaacagatacagagtggctggaacacctggagccttccgttgaaagaagcagagaaggcaaagacagcactctccccgattcagagcatctggaaatatgtggtcgggtatgacgcaccccttcagcagtatgaaagccccatcctgaatggcggttcaggagatcagagtgatgaacggcttgtgaaacctcatcaggggtactggctctatagtgcaggggaaggggagattaccggataatatctctaatccgggtaatttctgataattaactcgttaatatctcctcttttttcaccaacgctgttgataaaccgttttgcaagtacccgttcaatcagaaaatctttgtacagatcatcaaagaaatggtcggctgggtcctcatttctcggatcagaatttgagagcatcacctttgcaccagtgttagccaccgccccataaaaatcgcgaagcctgagctggtcctgctctgaaaacccttcctgtgagtaactggtgaaggatgaggtcttatttaatgggcgataggggggatcaagatatacaaaagaacttctgtcaacatactcaagacaggtggtaaagtcgccctgtatgatggttgtatgggtgaggaggttggaagccatcaggaggtttttttcctgaacgatattgggatttttatacttcccgaatggaacgttgaactctccttttgagttcagcctgaaaagtccgttaaagcaggttctattcagaaagagtaactgcgatgcccgttgtatggtatgatccccgtatgtgttgtaatcaaaagagggtttttcccggttcagatcatcacggacctggtaaaagagattgagcctctcggcctcagttcgggtatcatatgcatcctgcagttcctgaaggagcctgatgagggtcttgacatcctgttttacaaccttccaggtcaggatcaactcgctattgacatcacagatgaccgcttctttgatcggatagagctggactatataaaaaaagaccgcccctccgccaacaaacggctcaacataccgaacgagatcaccagtctccagagttttaggaaaccgcggatcaaattcatacaggagctgactctttccccccgcccatttaaaaaacggttttgcatattcctcatcgcctttagtccgtcgcccacgtattgactttatcagattctgtctgccttttttcatgaaccctgtagtatgtggatctgataggacataattcggacgggttataactattcaattcatatgtataacaaatgaagaattttttttgtctgcttctgggcctggtggtaggcggcctgattctggccatgcccggagatctcttcatatcatgggaaattcaggcgacggcggctgtaaccacacttatggtcatctggtggataacagaggcaatgccaatacctgcaaccgcactcgtcccgctcgtcgggtttcccctgctcggtgttcttactccggccgaagcatcggcgccctatgcagataagaccatcttcctctttcttggcgggtttatcattgcggcagccatgcagaagtggaacctgcatcgaaggatcgcccttactataattcttctcaccggaacaagtccgaaacagatcatcctgggctttatgatcgcaaccgccttcatctcactctggatctcgaacacggcgactgcgatgatgatgatcccgattgcggtggctatcatcggcactgtcgggatggatgtattcaaagagaaggaaaaagatgaaggggtttctgactttgcaaaggccctggtcatctctatcgcctatgcagcatcgattggtggtcttggaaccatcatcggttcaccaccaaacgggatcttccttgcccagctcaagaccctgtttcctgatgccccgaccataggatttgttgactggatgctctttggtatcccgctggttgccatcttcatccccctcacctggttctggcttgtgtacggaccgttcaggcacctgcctgcaaaacttccccagagtcgtgagatcataaccgaagagctgaagaaattaggacggataaccactggtgagcggtggacgttgatcgtctttgtcatgacagctctgatgtggatcttttcagcaacgaaaaagatcggtgatatcaccataccaggtcttgatatcctcttccccggtattgatgactcaaccatcgctatgtttggagcgatccttctcttcatcctgccagtgagcatcaaaaaccggcagtataccatggactgggagtctgccgccaggatcccctggggtattctcctcctctttggtgggggtatctgcctctcaaagggctttatcaaatcaggccttgctgatgaactggtaaaacacctgactggtctttctattctcaatatcctggtcatcatattcctggtggcggttctggtatcgttcctgaccgaagtaacatccaataccgccattgcctcggttatgatgcccatccttgctgtcacatccgtcagtctgatgataaacccgattattctcatgctcaccgcagccctgactgcatcgttggcatttatgctgccggttgcaaccccgcccaatgccgtggcctatggaaccgggtacctggagatgcgggatatgatgcggaccggttttatcctgaatatgattggggttgttctggttaccctgtttatgtatacggtggtactctgggctcttgggatcacctttgagctaccttcctgggcagttgccccctaaaaacccgatttttttcttgaaaataataaataagcgccacattgatctcgttttagagatatggatcaatttcataagaaactacttaaaaaccggggcacgaggtactgagaggctcacagggaatccggtcatatgagtactggtgaagctatccgtatgaaggattcatctgtgaccatctcactcatacaatagtgttgtcccgggtgtataatggaggtatcgttgacgtatcgtattttttcagcaactgtgattctgcttttggtggtgtccggaattgcatatgcagaccggctcccgtcacaggttcctgaaaaccagaagattagtatctccacgatcatcgatgtggtcggattcgtgtctgacaagtcctacatgtcatggaccatcgatgattcagagacaccggtaacgacgaaacaattgaatagtgggaccggatccacgccgaccgttttgaccgatgagcaggtgcgggcacttgctgctgcaaagtcaaccatagcaggacttacctactcggtcggtgcaggaaatcagctctattcacttaccgtacccgattatctgctgagtgatctggcattgcccaatatcgccccgaccgatccctggtgggggaagacctggcagtccattctgaatacacttgattcatcgtcgtattcacagacccaggatacggaatatggcagtatccatgacagtaagctcaatccgggtgaatcgattgctattgtgacattctcagacagcatcatgaccaatggcggccatctcatgctgaacaaggatctcggctttgactcacagaacaaggggaagggcctctcaaacctggaggttgagaaggtacttacttatgagagcattgacggttcattccttgtcggaagtgaggaatggagtcttgatgttgccggcaattatgcaaatactgatgattctatcaggtgtgtctttgcatcggccaaggagagtgttattccggcattctgtaatgtggtaaaggcgaagagcgaacttatcaacttcaacagcgggcaggtctctaccaaaggcagcctccgtgctgttgcagcgacaagtgatgttccggctggtctcttctatcagattgcagtcactccgattccaggttcaggctctggatttgcagagggaactgtaaagactgagttcgccggctctatcatggaagcccgtggcaagtctgactctccatctgcaacgaaccagtggtctgacaagacgtctgtatccggtggtatcaagaacttccaaaagacgttcgggtacgagtctggtgttactatctaatcctgaaaccctcaggatttgctttttttaaatgaacctgtattccaggtattattcttcgaataatctataatctcataacgcaaaactccccatggtttatatgtctaggggttatgtgtggatctttttgttgatactttgtatcatggcaacaggaggatatgcggaagaacaacaggtgccgtttgtttcggccccttctctctcgataacgtcagcgtccgggactgatgatccggtccccgtagcaacaaatgaattgaacccggctgcaggaaacccggtaattcaggcgactaataagattgtacagggagatatcgtatttattggtgaaggatctctggatgttacaagcgcgctaaataccgccgggtatattgcctggtggcagagcggaaatctcaatccggcagctcctgacgctgtgatcccggtaccagatccctacaatttccgtcttgatcctgctgattttgttcagaaaaccggtgactggtaccagtgggtggataaccagaaaggagacctggccttcagggtggcggatccgtctctgtatctggagatctgggatgcctcaacaaatacagatgtgaccggaaagaccattcccatgggtaatcttggaacattctgtattgattccaacctgtattccatcatgaacaggaccggatatcttcctggagacagtagtattaagatcacggtgaccagcccgtcaggtgattcccttacctatctggtcggattgaacggggcggagcatccacttacccatctgcaggttgatcttcccagatggtactggattggtcaggggacggatcactctgttccgtctcatgaagacgggtggaatacctctgtttcctacccgaacggcactcgtatctaccagcctgggatctataccgtccgtgctgaatgtaatgtcaatgggatgaagaataattacaaggctcctgacgggtctgattatgtgaataaaaccgtctcgatgacccacacggtgaaccttgtcgatgatgcggttgatatccgtgcaagccctgagctggttgtgccgggtgagtcttttgcgacgatcatcaccggtctccctcataatgagtattatctctggatgaaagggaccgggaccatgaccggacagccaggggatcagccaccggtgattgcactcatgcaggataatgtagtacatgatgcaccttcggggccctatctcatcggtgattatgtattttctgacggaggaggcaaaaccatcaggaatgatgtccctcgcgatcccacctggaacggaacacagttctatggcatggtcaaacttgatgcgaccggaaccagaaccgtttactggaatacgagtgcggcaacaaaaccaggttcctataccccggcggttgaaaaaagaaccctttccgggtatgtcagtgatacctgtatgctctcggtggataccggtaatgtaagttcattaaatctgttatccggatggaattttatctcaacgccgaaaaccctgtcacccggccataatacgatggcaatcttctccgggatcaactcatcagggcattccatatttacctatgatagcactacgtcctcatgggttactatgaaatcagaagacccgttctcaccattaaccgggttctggctctattctgtccaaccgacgacgataccacttatatctgacaatgcaaccgttgttccccggactctggtaaaggggtggaacagtatcggcatcaccgctccggacagaattgctgccacagttttgcagccgctcggggaggcctggtcatatctcatcgggtatgatgcacaggttcagcagtacagaaatccgctggttctcggagatccagcagtaaacaccacaacgctgtatacaaaagagggatattggatatatgtaaaagagaacctgaccttctcagggtgatgggttatcggtttaattttattttatttcctttcagtctgacaatctctaattttttcagatcttccacgacctgctttacatactctggtgatatgttgaaaaacagtactgttctcgttccttcgagctgcttctcctggatctcctgaacagctctgatgaggtcctctactgtctctgcctttgtcctacttaagatatggacgatatgctcaacaatctcctgtttcacataaatggcctgaagaatgattgcaatactctcgtttgatatatcactgttttcaagttcgtcatgaaactgttccacatcaattttgaaaattaattccggacctgcatgcacattatattccaaatctgcattcatcagctgaacaagggtaatattgaatgactccagctcctcctcactcggtataattccggaagttggttggaatgtgtagaaaagctcttctgcggggataatcttccgaatgatcatttttttatcttgaatggaaatgagctcattatccaggagcactttattcctcataattgcagcaatcgttggatttacacccacctcatccttgttagccagctcagcatcgtgatcatacacaacatcgccttctttcagctcttcaagggtttttatagcattatcccgatcgagggtaaggatggcgagaattttctcgactgcttcaaggtcctcttttatatcctcgattgcctcattttcatactgatcatccggggtatcctggttctcctcctggacttttctcatctcattctccaggtcctgggtcaattcttccctgcagtgaacaagataggaatgaatattgtcaaatgttcctttcaccctgattgaaaagcgtgacgatgaaaccggttcgattctcgttgaaatgtcactttttcgtaaaaatttcgtaagtctttctgcgtcttcaagattttcgcatgtaaaagtatggcctaacaccataccatatgtgtctgctctatgaggtgataagcaggatctattgcaggtttcccactgctcatatcccatccccgatggcttttagggaggacaggttcatgagatatcctgtctaactctgttcctcatgtatagtcagaccgaaaaatcggtccttctccttatatcatcactggcatcatttctggttccctataccgtatcttcattaaatgtcgctttgccagcaattggttcatcatttggcctcgatgctgtaacccttggatgggtcactacagcatatctcctcattgctgcagtattcatgctcccgtttgggaaacttgcggatatatatggaagaaaacgggttttcatcattggtactattctctttgctatcggatcgcttcttgcagcgatatcatggtcaggatcggtgatcatcatcgcacggatgatccaggggcttggcggtgcaatggtcttctctacttccatggcgattgtaaccgttgttttccctcctggtgaacgggggagggcgattggtattattaccgcaacggtatatgcaggcctctcacttgggccggtcctcggtgggtttctgacgcagatgtatggatggccctcaatatttattgttaatgtcccccttgctctgattgttgtcgtgctgaccattctcttcctgcatgatgaatggaaggatctgaaaagcgggtttgactctgggggtgctgtcctctatggatgtatgctcatggggattatgtatggcctgaccgttcttccttccccggccagtattctctggatagggggcggggtggcaggagggtatctcttcttcaggtgggaacaaaaacaggaacggccacttatcaggctgtcaacgttcagaacgaaccggacctttctctgctccaatgtggctgccatgatcaattatgcggttgtatttgccgtgggatttctcgtgagcctgtcacttcaatacacacgtggctttgatccggctacaaccggtatgatcctgttggcacagcccctggtccagacggtcgtctctcctctggccggaaaagcatcggattcagttgaacctgccatcatagcaacgctgggtatggctgccacgaccatcggacttggagtgctgctgattgtgctgccgtccggttctgttctttggattctcgccggtcttgtcatcctaggtcttggatacggactcttctcttcaccgaatacgaatgcaataatgagttctgttgaggtaaccgatctgggaatggcatcagggatggtctcaaccatgcggacagtcgggcagctcatcagccttgccatcgcgatgatggtcttttcggtcgtgatcggaacggtagagataactcctgatgtctaccaccagctggaacagagcacatcaataatctttatcatatgtatcgggcttggaattctgggaatattcacgtcatatgtcagaggaacggtcaggaaccatgagagtgaagagtaattccggttctatgggttataatacccattcatgcccgtgttttttcagatattcccgtcgttccctgtagtccggcatcattctctctacggtattccagaaacggggtgaatggtcagggtgaattttgtgggccagttcatgaagaaccacatattcaatgatccgttgtggtgccatacagagccggaggtttaagatgatactctttgatgtgcatgctccccactttgtcttctgatcccgggtttttatctggggaatgggcacgttgagcagggcaccataccgggtgaaatacgggagtgcaaacagagagagctgctctgcaaagaacgcagaaacaacctgttttactgccatttttgagttataatcggtgaaatctgccggaacggtaatgagtaattcatccccctgtcgcgaataggacaattcatatccccgcttgattctgatggtgattgattcatccagaaaagggaagacctctccgtcctcataggtccgtttcagaggaaggggccggacgcttccgatggtatgggtatacacccactctgcattctgggtcataaatgcatgaatgtgagtcacggatccatggggtggggatacaacacagacttcacggtcccggtttaccttgattgtggtccgtttcgcacgggggtttcgttttatcgtatagggtatggtatgcccctcccaggtgacatgcccggcatctccccccgctgtgtttgcagaccccccctgcagaatgctcccttgttggatctccggcacctgaactccgatttttggtgcaatccatgacttcctgctctccacaaaggcagtaatggtatcagttggtgcattgtaaggggcagagacttcaatggttccattcccatgcaccttcagagtgatccgtttgttccgggtgctgcgggagatctgatacgggatgggtttttcattgatttgtactgtatgctcttccctggaagggggacagtccgggcgggtgcaatagtattcccggtatatccactctttttcagaggtgagaaaccgttttatgtcttcttctgtggcattcccggggttttcaacctcgactctcccatcagggtatattgacagatagagggtttttctccgtggattgaggacaacggagtaagggatatcatatcccctgatatggatcgttccgccggtgaatgatggggtaggtttttgtgtgccggcaggttttgtacccttccaggtgagatagttttggacgccttttcggagttcctctttggataacccgtatggggcctgtatgataatacgggtatcagaaaccgggctgtactggatctcgttctggtcttttcgatatgataccagaacctgaatggcttttccattcatctgcaatagtatcttttcaatggagatctccggatcaaatgtgctctgcatagctggtgtcagtgttttcgatgatagaggtggtcagtcagaagacataatcatggtcaattgtgtgcaggaaagcatgccgacaggtgagcgcatgtccagtggaaagaaagggatatatatatgaatgtgaatgaagcatatcgacgtgaaatcatctcaattttgatgcgtgcatgctttttggaagaacttgatctgttcgctagggacgatgtcaggtagatggtttggtatgtgggtgtccggtagatgtccggtggaaagcctctcatgacaggatgcaaaaggggatcagaaaaaccagtaaacttccggttcacccgcaggactttcggtgttctcctgcaactcttcatgaggatatccgatagcaacgccggcgacggcatactttccggctggcagatggatgagggagaaaaattcggatcttctggaaaggtatgagataccgggtatcagatgaactccaagatgatggaatgtggcagagatccagaggtgtgagactgcaaatgccagggattcctgttcgactggcgggaatcttcgctcctcggtgatgataatgatgattggtgcggatttgaaactggatattcccgttgtttcgaaatttttgagcatctgaatataatttcccggtccttccggggtatacgcacgccatccgaagaaagagatgagttcatcacgggtggtttcgattgcccttttgagcacctcttccaggttatcacatgaaggagttccggtcctgaagacaaagaatctgcggagattcggaactactggttcaggatacgggtagggagcctgaaagccggcatggatcacctgatggagtaccggatctgatggaactctggctgaaaaaacatataccggtttacagaggatatgggggtgctcactgcttttcattggtacatcatcgtagggtatcattctgcgtctttcttctgtcgtagaacgtatggtgatgcattgagccaatctgttttacggatatttatatatggcccttagatcattatcacatcattgatgtaccatgactaggatggatggcactattattgaacaactttgtccaaagatgctggatgaagttcctgtagcggttctccttattgaaaacggtatgtttgtgtactgcaacagggttgcagtcgatatgttccatgcaaccacacgttattattggtaacggagaagtcgtgatagatacactcttgcccagatgaatgcaagtgtcccacctaggatgtcaccggcaacaataccccaccagattccgtgttctccataccccagaactattccgaacaggtaggcaaatactgcgataaagagaaggtttctgaatatattcagggcaagtgaggtcattcctttcccaactccctgaaagagggaccctgacatgatacccggtgggacgaaggggtaaaagaaacacatcgttgcaaggaatgctgcaatggatggtgcaagatggatactctccggtgaataggtgaatattgttgctatctggtttgaaaaaagccaggtgatgacggagaggcttatcgctaccatgagccccgtttttaccgagtagttgagaataacaggcagtttctcatatcttctgccaccaaacgccgctccggccactgatatgactgatgtgccgattgcagcgaggggtatgatggcaaatatgacgacccgccatcctgcagcatatacggcaaccgcatctgttccggcaacatgaacgagcaggccattaatgatgattgccagaagtgacatcaggaaaaattcaaggctggcaggaattcctacgctgaggatatcccacatggtctgtctctgatatataaatgatctccgggagactgatatatacgtgtccttctttccaaaaaaccagtatacgaggataattgccacaaatacctgtgatatgaccatcccccaggcagctcctgcaatacccattcctgcggtgtaaatgagcaggggatcgaggaccatgttcatgagggccgatactgccatgaggtacatcgcccgttttgtatctccctcggcacgcaggattgaagaccccacactcgtgagcagaagcaggattgtactcccaaatactactcttccgtattccccacagagccctgctgtctttcctgctccgaacaatagtgctatgtccgtggtccagatgaccagcggtatcgtaactagggcagatatgatgactgtcaggatgattgcatgaaaagcagcgttgttcgctccctgaagatctcctgctcctatcttccgtgcgattgcagaggttgttcctgccccaagaccatttccaagaccgataagtaccagaaagagcggggagataaatccgactgccgccagtgcatctgatccaagccctgcaacccatatggcattgacgatgttataggttgaatagagcagcatagcgatgatcagcggtcctgataattttcgaatcgctttctccggttcacccagaagaagtgatactccgacagtctcctcctttttcatcgctggtaggtttatctcatgtatatctgtattcggcttcaattctctccctcaagtgcccgaattgtttgtatgcttgacgatgcaacctgcctgagtaatacttgcaggtgctctttctcctcttttgtgagctgacaactgactgcctgttcccattcctggtcaatagccatgatctcaggggctatctggtatcctttcctggtgagtgaaaggcggaatgcacggcggttatccgggtcaacacgccgtgagatgtactctgcatcctccattttttttaccgtccgggcgatggtgcctttatcaaggtgaaagtacttggccatggtatcctgggtaatgtcaggatgtttgatcaggcacataaaaaccgggtactgacctgctgataatttaaacggctttaatcgttcatttagaaagataacccgtgctctgttgatgatggataacagtggtccgggtggaagtgatgatggaagtggtgaatcagacacgtgtacaggtgttcattggtgccatataatgttgcttatgcaacagttgtgtatgcaataaaaaggaagtgttattttttccgttaaatattcagtccgatcttgatctcttcatgatcagggattgatatgttcccttcagttgaagcgatagtgatagactttcctgacttcgattctccataatccttactgatatcaacagtgatggtaaggatattcccgtctacctttatgtcaacattctttatatgatatgataggcatgagaatatttggagtttttctctcccggatattctctcgtgtatctggttattcagtaaatgtcagtttgaatatctcactgtcaaagattttcgttccgggtcctgcatctgcggcttctgaaaccggcgcaaagatctggaacctgagtgtatgttctccttttttccggtatttgagtggaatgtcgaagaagtttgtttcctttccatcattgctcagccattcatgcaccagtgagatctcctcttcatcaacaaaaattttggtaattactttctggcgttgttttgcatcatgtcggatctggtaaaaaaaccgggaatcactgaccggggtggtgagggatttttgaggatctacatctcctgcctttgttgtccagaatccatgaattcctatctccatatgaggtcaccagttatctgtttgcttataggctgataataccattggatattcatgcagggaatatgccgtctgatttgaaaaaaatcccaccctataatgactatgtgtagagaatgtgttttcctgtcatcaccagattaccggtattgaattgcttcttaaatgtctgacataaagagaattataaatagagtcttggataatagatgtctgcctgaaaacgtataggaatcatccgatgaagcacatttcatggtttgattttcgatcaatcaaacaaaaaatcctgttttttggtggattcgccttactccttgtagcagcatgtattattgggtatgcagcgtttgctctgaattcagaagcgatgaatgctgctcatgatgagatgaacagcatagcagaacgtgaggcagcatatatcgggaaagttctggaagagccgtattttactgcctcaagtactgcatcaggtcttgcagggatacgggagaagaactctcattttgccaggaccgatgtgatctccttattggagggcatattaaaggatcacccgctttataatggcatatataccatctgggaacctggcgtatttgacgggctggatgagcagtataaactccgggaaggatatgacaagaccggcagacttcggatctactggtaccgggatgcagacggaactcttgtcaggaaaatgtatgatgaaacaacaaaggatcccggatcatactatgatatcccaaaaaagaccggcaagggtgagctcatagaaccctaccttgaaaccatgcagaatccaccggttctcatggcctcggtgtcattaccggcgatgatgaataacacgtttgccggtatcgtggcgatagacatcgctctgactgatattgaaaagattgccgattctctcgacctgtactcagggaccgggaagatggtggtgctcagtcatgaagggctgattgcaggagcctccggcgatcaggatgtagcaggaagacccttctctgaaattgctgcttcgcttggtcttccacaggagatcatccttgatgccgtttcatcaggtgagaagagaaccttctcatacaatggattcattggatcgataagcccggtgattgttggtgaagccccaaccccctggagtgttgtggtctatgccccggcagatgtagtgacgagaaaggcgactgaacagacgatcatactcattataatcggtatcgtgttctccatattcggtctcttcctgctcttccttgttgcccggtccatatcccgacctattgaagagattacgtctgtcgctcatgatctctccctgggagatatcagcacccaggtgacgatacagcaaaatgacgaagtaggaaggcttgccgatgcgttcaggatccttacgaagaacctgaagaacaatgcagagtctgctgaacgtatcgctgcaggtgatctgaaattcaaaattgaagcggccagcgagaaggatgtgctgggtaattcaatgatccggatgaaagagacattatctggtgttacggctaccatgaaccatctggcaggaaaggcagcatcaggtgatctctcggtcagaggggatgctgattcattttccggagaatttgcacttattatcaggggagtgaatgcaacgcttgatgcagttatcgctcccctgcatgaggcaatgcgtcttgccaggcagtatgcggataatgacttttcagccaggtttgatcccaccgtgcagacaaccggtgatttcgtctcattcagggacgcgatgaatagtattggtattcaggtgacaaagaccattcagaacatacaaaacaggatggttgaactgactgcaagcactgaagaggcacaggcatcggcagatgaggttgcccggggttcatctgtcgtcgctgaacatgcagaatcggtttcggtcagggctgaccagggaagcgaagccacgagccatattctccatgccatggaagatctctctgttgcggtgtcagatgttgcaatacggagtgaatcggtctcaaagctcactgaaaaagggaatgatatcagtaaacagggtcagaaacttgcatctgcagccagtcaggggatggaagggatacgaaacgcaaccggcgacctgaaccggataatcctctccatccaggagcagatgacccagataaataatgtcattgcaatcatcaccggaatttctgatgagacaaatctgcttgcactcaatgcggcaattgaggctgcacgtgccggggatgcagggagaggatttgcggttgtggctgatgaggttaaggatcttgccatggagagccatgcttcagccgagaagatagaagagatgatcagaaacctccaaaaggagtcttccagggcatctgatctcatgagcagggctcattcccaggttgaactggggtatgaggcagttggtcagagccttacgttatttggagatattgccggtatgctggaacagatcgcccgcgatgtaagcgacgttgctgcgtcatctgaagaagaagcagcgtcagtttctgaaattacaagaaatattgagcatgttgcctcacttatcaaagagaccgcagacagtgcagtatccagtgctgcagtatcacaagagacctcggctgcagtagctcagatacgaaaagttgttgaacatgtgaacagcgttgttgcttccctgcaaaaggagatcgatcagttcaccatctgatccataccgcccctttattgcggatgataggaaaacgtaactgctatcaaaaaatgaaaatttttcttttttcctcacacgttcgctctcatctcatactggtacttttcattgttctgagtgggattggaatttgtggagtcaatgctgatccatcatatgatactgctctttctctgattcctgaagaactggaatggatctctgctcatcctgttatcaggatctgccctgacccccattatcccccgtttgaaatgctcacgtctgatggcgggtatcagggaatatctgccgatctcctcaggatcatcgccgaacgtgccggacttacccttgaggtcgtgccatgtgagaactggagccagtgtatagagaaaattcggaatcgagaggtcgatatccttggtgctgtgtttatttcagaccttcgctcagggtatctctcttatactgatcccttttactcgtctccacttgagatcatcaccaaaaacaccgccccttccgatctaacgctggccgatctctccggaaagtcagttgcagtcgtggatggatatacatcacatctcctcctggtgacacattatccagatattcataccgttgttgttcctgatgtcccatccggacttgaaaaggtcgtgttcggctctgctgatgcgtttcttggtgatctggcaaccgcagcctatcatacggaaaagtcagggtttaccaatctccagatatcaggggagggttcttttgcgaataataccctgcagagccttgcctttgggattcgaagtgatcaaccggttcttgtatcaatactcaataaagggctgcatactctctctgatgcagaaaagaaacgcatattctccacctggatacctgcatcactcgtcccgcccctgataagccgggagattctcattgcagcaggggggatcattgcctttttctgcatcatcatcgttgggttttatgtctggaacaggtctcttcagatggcggtcgacgagaagaccaggcagcttgtggcagagctcgatgagcggaaaaagattcagaatgaactccagaataaaaatgatgaactatccgcggcatatgaagagattaccgcgacgcagtatgaactaaagcaacagtatctgcagctgatgcagaaccaggaggaactcaggcagcaggaacgtacgttaaggcagatccggttctctattgatcagagccatgatatgatgttctggcttgatatgacaggtaaaattcgtgatgtcagcggaagtgtccactctgttcttggatattcacatgaggatcttgaatctttggatatttcggcgatagatccaaaatttacgatagattcaggacttgaagtctccggattggaacaccctgtcccggtcagatatgagacagaatttataacaaaaagcggaaaatcgctcatggttgaagtatcgcttatctcctatgaatatgctgacgagaccatgattctattatcagcccgtgatatcagtgaacggaagatgatggaagacctgaagaaaaaggcattcacgcagattgataaaaatatcgagcagtttgcaatcttaaacgatcagatacgaaatccgctcacgctcctcatgatttacgcagaagagatgggtacaaaggacgaagcaaaaatcatggaacagatatccaggattgatcagctggttgataaactggataaggggcttttagaatcagaaaaggtccgggggtttctccggagatattatgaacacacatctgatacccgggaaccacttgaggatacctggtaagtattctataggggttcctttttagacgtatgaattaacccggttatttagagcaaagctccatctcttgtcactggtttggattatcacggtttcatcctcttttttcacgatgatgctccctgcatggactgcctgatgatggggggcacagagggtgagcatgttctctgccaggtcttttccctgcctggataatgggattatatgatgaacttcaaccggtcctgtcgtctcttcacccatggcagaacagatctggcagcagtttccatggaggttctttacaagatatgccagatatcggttccttttcgtctgcatcggaagaattctccgttcctcctcctgaatcagagaatgaatatctcttcctgccttttgcgctttcatgaatacgtgatggtatcgtcgctctgagggtggttttgtgatcgttcctgcggcctgtatgaggacatcccgctcctgcccataagggtttacttcctcttcattttcaggaaatacatccagtaatcttagaataagtaggggatctccgttctctatccggtccctgatagtgggtttattcagaattgcatcgagcacttggcggctattgaccggaatgagcccgaatcgttcccaccattcaagaatgatccccagttccacctggtcagaaatcagaaatttcagcctcccccgcttatttaagaccatgtttgccagggcatctgcagcattcaggttgatcaggttttgcagatccgggttactcttgaagaatatctggatgatcatggcaatccatccaaaatcaggtgaatatggtccttcggcccgatgaaagaggtattcaagataggcaatggaggaggatggaacacccagtaccagatcatctgatttggcatgtcctgcggtgcatctctgaatcgcggtccggatatcagaaccggttatgaatttgccaattcggatcttctctgtgaggctgtcaaaacatggaatgcagtcacgccaatgcaccggtttcatctcttctctgtgatgtttgtttttactcaccgccaaagtgaaaggttgtcccgactgtactgaatacgaaggcgtgtggcattgcctgggccatggagacctgggcctcccacccggtacaatgaacaggtatgatgcatgcaggctttatctcctgcagggccaagatggtgtctggaatgatatttttgaaatacggacctgataggtggaaaccccccatgattgcgtaaacagtatcaatgccggttatcttttgtgcatacctgaccgaattgattattcctgcatgggcacaacctgatatgacaataagacccctctctttgaggtgaatgataagtgcctgatcatcacggaaaacgtcttttacaaatgaatctccctcccttgcttcaagaaccggagaaccctgctcaaacggagttattcgttcaatctctccggtaagcagaatcttctgattcgcaatcagtgagggttctgtagacagggagagtatgccgccggcgtgggtgactttatcggcagtcattgaaggaagcgtggtatacgtgccatcaggcctcttctttctcctcatggaaaatgctgccggatggagatgaaccggaatacgacaggatgactgacgaagaacgtggaaaagagcaccgatatgatcgaaatgtccatgactgatgaccacttcactgatctcatccagatcaatccctaatgttttcgcgttctctatgaaggccgtttctgtagtcccggcatccataaggatagtatggatcttctccccggatcgtaccctgatcagaaatgataacccatgttcggcaaaaagggtctttccatcagagagtaatggccggcgaataagagaattctgctccaccatgaggagatcagtgtaattatcgaccaggacggttacatccacacggtcaaccggacgtaatagatatgtcatagaatcacaaattttgtctaattatctctcatatggaaaaataagtccttcttttgtactctgacagtgcagtcagaggttggtatgcagacatcgcaggacgctgaaaaaatatttatactattgtgacaataatacagattgtaacctgcctgtaggaattatcagagatctggcaggattttgtggatggatgcatgaggtgaaaataggtctgatcttctcatcagtctccatccattcatattttttcttttctgatctgaatatcctctgattacggaagactatcattaaatatagtttaatatcatactatctgcattaatccagaaagtttgacgtaacctataaagtggatatcaagtacaggttttggaatagccaatggttcatattgattatttcataaccttttgtcaggcactctcatcatctgaacagattcacctgtcataaacatgtcataatatcatgacctctggaatgtgtgtcgatacaaatgtctcatattacattaggaaatcagaacaagtaccgcttttttgattgtctccataaaaaggaaccggcatgttcaaaccttttgactggctggcgtaccagataacgagacatccgggtgttgtcgccggagtcgccctggctgcttttatcgttgcactgtatggcacaaccctgattaccatgcagaccggcaatgaagcctatcttgacaaaaatactccccgtggcgcattgctggcacactatgcagatacctacggttcagatgccattatggtcatcatcgagtctgatgatgttacgaaagtagataatctctggtatattgacaatctcttaaaccatatccagaatcagcagtcggttgagcggacatccagtattgtggcactcttaaaacagggcaacaacggggttcttccccggtcatctgcagaggttaaaaggataattcaaaatgctcctgcagagattgtcagccggaaccttccctcgaatatgatgacactgggcgttatcacccttgtccccggcctgtctgaggatcgacaaaagcaggttttgtcaaatattgagaccattgtaaagacatcccgtcctcccccgggagtatctgtcaccttatccggagaacaggcctttaaccaggagatgggaagggagatgggatcatccatggggattttaatcatggcggcgatgattctcatggtgatagccgtcctggctctcttttcccatgtcaggtatgcactcctcccggttgtcatcgttgcagcaggccttgtactgacctttggtctgatggggcttacgggaacccagatcagcatggtggttattggtgcatttcctgtcttgattggaatcggtattgactatgccatccagattcattcaaggcttgatgaggagatctataaaacttcgcttcctgaagcggttactaccaccattacaaagaccagcccttcggtcatggtagcgatgctggcaacatccaccggttttattgccatgatattcggcccgataccaatggtcggggattttggtatcacctgcacattcggggtgatgtcctgctatatcgcagcactgatccttgttccggtctttgccatgctgattcagtatcgtgggaagaggcagacgaaagatcctgcccacgatcatgatagcaccaagggcaccggacagacgacaacagcctatgaggggaatgccaaagaatccctgatagagaagtacgacaggattttgggaaataccgcattaaagattgcacagcgcccggttccggtattattatttgtattcattattgcagcaatcggatttactcttgataacgaagttcccatcagtgcagatcaaaagacgtttgtgccccctgacatgcctgcattattagacatgaacaaggtaacacggacgatgggggcgacgaccaccattcccatcattgtatcagctgatgatgtcctgcatcccgaaaatcttgcctggattcaaaatttcggtgcatatgttgtaagaaaaaatgacaaagtcactgatgcagacagcattgcttccctcatcgcagagtataataatggcaccctgccgaaaaccagatttgaaacgacacagattctctctgccatacctgatcagtataagaagcggtatctgaatgggaacactgaagcggtaattgaattctcaacacgggatatggagattaaacaggcgagagacctgataaaaatcatcagaaaggacatgaatttttatccatcccccccagggctgaccatcagggtcaccggttctcttgagatgttcagcactctcatggatgatatcgaccggtcaaaaacgttcatgaccatccttggatttgtcttcatcttcggatatttactactggtataccgtcgcctgaaggcggcagttcccctcatccccataatcgttattgttgggtggaacggggctatcatgtatcttattggcctggattatacgcccctgaccgcggtccttggatcgatgacgattggtgttgcttcagaatatactatcctcatcatggaacgatgtgatgaagagctggcacggggcctgcccctctttgatgccatacaggtaagtgttcagaagataggaacagcaatcaccgtatccggcctgacaacggtgtttggttttgctgccctgatgttatctgagttcaatattgtagcaaattttggaataaccacagtaatcacggtggtcttctcactcaccggagcgatatttatcatgccagcggtaatctcactggtatatcagttccaagggcagaaggtatagccatatgcagctccggtgatttccagtccattttttttcgggtatccgtttttttatatcctctgactggcagtggattcaaatcattactattatcgtctcatatgccatgttctaattaggcatatgatgatctctgtcctctatgtagatgacgagtctgactttttattccttgggaaaaattttctgaataaggaacctgacattaccgtagatacggttacctcagcccaggaagccttaacaatcctgaaaacccgtacgtatgatgccatcatatccgactatcagatgccggttatggatggtatccagtttcttcagaaagttcgttccctctatggccggataccctttcttctcttcaccgggaagggccgtgaggaggtggtcattactgcattaaattccggtgttgacttttatatccagaaagggggcgacgccttctcacagtttgccgaacttgcccataagatccgtcaggcagtggagagaaaacgggccgaggatcgtcttattgagagtgacaggcggtttagaaagacgcttcagaccatgaaactcatcgcctttcagttggatagtgatggaaaggtgctgttctgtaatgatcatctgcttcatctgaccggctggagaagagaagagttcatgggcagggatttttttgagatggccgttcccgaagatctcagatccctaaagaaacattcctttcaggaggccttgaaaaaaggtaccatctctcagcatgaggagatgaagctcctcctccggaatggtgaaatccgggacattgacgtgatgaacacggacctcagggatgaacacgggggtcttatcggctatatgtgtatcggggacgatatcaccgaccaaaaaattgcacaaaaagaagtggaagcctggcgtaaccggtacaaaatggttacgacatcatccggccttgttgtctatgattatgacatgaaacaggatcagatcatcatgagtgagaatgtcagtgatgtctttggatatgcatataatgagatcagtcatggatttgaacagtggcttgaacttgtccacccggatgatcgaaaggcagcccttgatgcgttttattcagtgcatacaaactccgggggagacgttgtcaggtaccggttcagacatgctgatggtcattatgtctgggtagaggatagggtttcagtgcctgatatcattgattcgtaccggcttatgggcattatggctgacatcaccaggcagcaggaagcagaggaggcactgcggctcagtgaggcacaactcaaaacagcgaatactaaactcagtcttctcagctccattaccagacatgatatcacaaattcactcagtgcaatgcaggggtacctctctcttatggaggagtgcgaaccccatgaaattcccgaatttacaaaaaaactgcgggatataagcgtgtcaatagagtctcaaatagccttttcacgggaatatgaaaaggtcggggtatcagagcctgactggttttgcgtatctgatatcctgaaaaacttaccgttcgagtatattcgcctgaactgtgaagttccttccaatctccggatctatgttgatcccatgattccgaaggtcttttataatctcctcatcaatgcaaagaaccatggaaaacacgtctctaccatcactgtttcatgcaggaataatgattcttccctcattctctcatgggaggatgacggcattggtattcctcatgaagaaaaggatctgatctttacctatggatatggaaagaataccgggtacggattatatcttatatctgaaatactgaagattacttcaattaccatctacgaaactggcatacccgggaaaggtgcacgatttgagatagtggttcctttcggaggataccggttttcttcatgatgaactgaaagcaggatagcgggtatttccttatattctcctctatcttgcatgattcctgatttctctgatttttccatcagacccatcaatccaatagtttatgctgattggaatcaaagtttgttgatccaactgatagtatagactatccagagaaggtgttatgagcaggtcaggaaataaagagttccaatatggtcaatattcgttgtcgtaccatattatgctcatcttcctggtcatagggatcatttgtacaagcatcatcttcgcctatctctatcatgttgaatctgattcaatagagtctgaatttttactttcccaacgatatggggaggaagcccttactcatgcgatccagctggcagatcagagcctctctttttatgataatgcatataatcaacctcttcgtctggcgctgctcgattatcaaaacctcttccatcaaaacgggaagagtcctgaagagttggatttagaggaaataaaggagaaactggcggattattttgatctccccatcgacctctatatctttaattcttcaggagtgatcattgcctcaacctttcagccagatattgggcttgacttctcatttgcgccgaaattcaaagaaagactgaataccatccggcttggagactctgtcgcatttgatgccatcgtaactgggacaaaactaggagaagaacgaaaatatgcatatatcccgacccgggatcatgagtatattctggagattgggataaatctccaggtgttcttcgaaaaacaggggatatccaagtatccacgtcttgcccgctggtataaagagacgaggcaggatattgtatcagtatggatatttgaccagaccttcaatcaggctaccgatatccggacttccatccccgggtttgcggtgtacccatatgaatttcaggaccggacagatcgttttgacaacctgaaaacggtctttggagaaaaaaagagcattgtcgttaccgggccacaaccaaaccagattacgaaatatctctatatcccacaggtgaaaagttcctcagtatcatctggcctgttcgacaaagtggccgagatcgtctactcgaccgaacaggtacgacagaagaaagaaaaggcattggtaaagaatatcctcaatgccctgatgatcatagcatttttatgtctcatcgcatttttcatatcacggtatgtaacccggccggtttaccagataattgaggatattgagatcatcgcagatggagattacgatcacccgatccgtcggacaaaggggtttgagtttcgaagactggaagcgagtatccagaagatggtgggacggctgaaagaggatatcatctcaatcaggcagaagacggatgatctgaatgatgagctacaaaaccggcgatatgcagaggagtctcttcgggcagcaaatcataaattatctctgcttggaaccattaccaggcatgatctgctgaatcagatgtctgtggtctcatcaggatttgaccttcttgaggacgagattccggtaaatgaacagaataatcggttaaaagccatgattcgtgatgctctgaattccatcagtgatttgatcctctttacccggatatatgagcagatgggggttgacaaaccggtctggcattccataagccggctaataaacgagacgatgaaaaatttcagtgatcagcccttaaccgttcatgatctgacgaacggtcttctggtatgtgctgacccaatgtttgaccgtgtcatctataaccttatagaaaattcgctccgtcatggcgggagggtaagccggatctcctgtgatgtgaggattgatgatacgtttgccatgctcacctattcagatgacggatcaggggtccctgcagctgataaagagaagatcttcgcaagaggatatgggaaaaataccggtcttggactctttctcacacgggagatcctctcccttaccggtatagagatacgggagattggaactttaggggaaggtgcatgttttgagatgaaaattccacagggaaaatggcggtttgaggatgccggtttgtaatggagaaccatcaggccggtgtggatcctaatgtatatacaatgttctgcattattgtgttaggttttttaaaaaactggaatatagggttatttcttaaaaatatcagattattggcgacacatgtggtccggattatacatctataagaactatttccctgctctgaatgtaatgatggcgcacctgtaattgtcagacatcatgggattattgttcaggttatatagaaaagaattataagtgatgacctgaaatccatatattttgaaggatataaaaccgatttaatacgctttttttcaataaaaagagataaattatcgtcttttaatatagccaaaggatagggtcagacgcctgtctgccacatccacgaccgtgtttttttcattgaagtgattttcttcacccaatccaaatatctgcaataatctggcaaatcgtgaaaatagggaatttttttggagtaagaaatttataaaaaccgggtgttttttatcgggaggatggtttttccttcatctctcatcctggtggcctggtctctatgacactgatcagagatatggatccggcaggagatgtgcgtgtggatcctgtcgtgtacttctcaccatccgttgtaataagaatggttcctctgatatcagtctgaaatacctctgccccgacagcctccagtcccatcacggttgctttattggggccttttccgatccgtccgacactgatgacagccacttcaggttttaagcgatgaataaagccggcatcatatgcctcccgtgatccatgatccgggacacgaaggatctggatgggatcaggaatggagatatccggtgaaccgttctgtgaaaggaggagcatggatacatttccaacggtgatcttcagaaccgcctcatcatatccggtctgatctgtctggttagccggaatgacttcaatagacgcatctttcccaatagaaatgatatcaccggctgtcagaggtgagtgcgggattgattcattctgtatcttctcgaggacccgtccataatatggatatacctgaccggttccggtatcgcgataatcgtgtacgactgtccggttcataacctccaggattcccccggtcttacccggatccatactggtcaccaggaagagatccagagcggtgatattatggtcggacagatatgccgctgtggtgttccggtcaggtcctgcatcgatcaaggtatatgtccctgctgtctccaccaggactgcatcaccggttccgacatcaatgacatgaatggttgtctcctctgccgttcctggtgaaaacacaagtaatagcaggatagaggtaaaaattattaatatgtgaaatcttttcatggtgtattgataccccccgttccgggcatatcatacgttgtccaacgtccctcaaatggcttcttctttggaggcggtttcacaaatcaattttgataatacaattaaggaattaacatgtgaatatgaaagttcacacgctgaatttgtcttataacgctcatgaaaacattcatccaacagcctctttgttgcgatgatatgcgatatgattgaggaatattcccaatgggagtgatatctataaacattgacagtaaagatgtataatcagacaataattttatggtccctctaaaacttcccatcggtattcagtccttttcagaaatcagaaccggtgggtatgcctatgtagacaaaaccccctatgttgcctcattggtgcaggaaggaaaatattactttctttcccggcctcgccggtttggtaaaagcctgtttcttgatacactggattgtgccttatcaggaaaaaaagatctttttaaaggcttgttcctcgatagtccggaatccagctgggacttctcagtaacgtggccggtgatacggattagcctgggtcagcggatcaataccacttcagacgaacttcatgaatacctcacccggataatcagccgggaagcagagcggtttggatgtgctatcaatcctcatatttcacccggatttcagcttgaagatctcattcgggatgtgaataaaaagacagggcttcaggtggtcctgcttgttgatgagtatgataaaccaattcttgacaatatcagcactccatctcaatccgctgtaatgcgggatgaactgaagagtttttacgggatgatcaaggatatcgatcacctgctgaagtttgttttcctaaccggtgtctccaaatttgcgaaaacaggcattttttcaggcctgaataacctcaacgatattactctggattcacggtactccgcgatatgcggatatactcatgaggatttgatggaggttttttctgattattcaaaaaacttcctggaatccgagatcagggaatggtataatggctattcatggaccgggcagcaggtttataatccttttgatattctgcttctcttttcaaagggtatgtaccggccttattggtttgagacaggaactccgacattcctcctgaagctctggcaggaaaaaccacgatttccggcagagtatgatggtctggtagcaggagaagaattactgggatcttttgatcctgaaaatatccgaaccgaaacccttctttttcaggctgggtacctgacaatccggtcatttgtatcaagcgctgaagaagggacgtggtacactcttggttttcctaaccgggaggtcagggagtcatttaaccgacagatccttaccgtgctccaggatgttcagaatcttgttcctcttcctgatatcaggagtgtgctcgaatctggtaacagccaggatctccatggtatttttcatacattcttatcctcaataccacatgataattatcggaataatctgatttcacgatttgaaggctattatgcgagtgttgtatatgcatatctggcaagtctgggatatgaaataatcccggaggatacgacgaataaaggcaggattgatttaactgtcaaaaccagatcatacatctggatctttgaatttaaggtaaaaggaattgaccattcgggtgacaaggaacccctgaaacagataaaggaacggggatatgctgaaaaatatgccgctgaatcccgcccggttattgaagtagggatcgtttttcatcccggaaccagaaatattgagtcatgggaagtaggtaaaccggatttttaagtcgtttttccggttactttctcaatactttccagtaactcctgtttcttatagggtttgaccacgtagccggcggcaccgacccggagagccagggcaacgacctgttcaagcccggcagcagaacacatgatgaccggaatatttgggaaatcccgtttcagttcacgtaatatctcaattccattgagtttaggcatgaccagatcaagcatgataaggtcagttggatgacttttcaggaaatcaaggatgtgtattccatcaggctgggtcagggtgttatagcccgcttcggtcagaatgacattcatctcttcaatatctgccggattatcatcaaccattaaaacagtggtcataccatcaactcatagtgaacagtaaatactctttccgatttatctctcattgatcttcatagggtaagaatatgtctaaaaaatctgaagtgtttggggaggttattctcccgctgttgcagcaactataacatctggattcatcgtgacatacagatcaaccgtctccccagctcccggatattctgtgatatcttcagtcaccaggataaagccgggctttgaagccaccatggttttatatggtgttcctgttgtatacaccgggatctggagatatccgttcatggtcatacccttatcttctccgtccatctcgatggtaacaccgtcttcattggaccagataaggtaatatccgacatctccacccagcggttttggtgtcggagtcgggcatggaacgggttcgatatccacgaaaatatcaatggtctgaccttttgctggaacacctggcaggtttctggtgacacttgcatacgaaccgcatccttcataggtaacggtatatgttgaatagggcgttcctgttgtatatatagggacagagagcatgccattctggatatctccgacatattcactgtcaaggtgcacttttgctccgtctgcatgacagtggaattcataccatccccggtcccctccaattttggctgcggttcccccggttacaattaatgctccggtaataaacagacaaattaatccaattctgaaattcatgtataaaacctccatcaggtgtaatgcaccatcaggtaatatgagagattcacgagggtataaaaattatctgattaccagtgttcatcagtctggagatgaaacatgtacctgaaacctgcgatggaaacctggacttctcatctccctgaaatctttcaatcccttgtatcaccagattatttcataccagatacctaccggctcgggacggacgcctatctggtcccttctcctgaccgccaggatctcctcttttcattcccggtggtattcagaatgcccatcattgaagagatatcccttccgctctctgcatcagctggggctgtacaagtcatcattgagcactgtaaacattcttcacaaaaagacaggacacttggcatcctttctggtgtcggaaccgggaatatgagtcggtactcggtgaacatcgagccctgcacggttgcttcatctgtatcagcacttgcatcccatctctggagaccggatgatgagaatgttctgtgttctcaggggattcagctgagtattcggggtgccctcccgtacctgccactttcttcgaacaacattgctcatgtacaatcagatattggttcatatctcgctgctcttgctgattgtataaacaaagttcctgtaagatccatacagcgggggtgggagacggttcttgatcagcagcatcttcgttcagaactcacccggatgggcctggtctgttttatcggtgatggaacccgccctgcaaggctatttactcgtcaccggagctggcaccgggtagcagggccaaaagacggtgttcatatcccgttttattgcccggctgaactttctccggttgaagtactgcttgcaggatcaaacaagacagtttccggtcttggaataaaacgaggtgagatattcgcaataaccggctcgaatgcagagggaaaatccaccttactcaacgccattcaggcaggtgtggatgatcatgctgctggtgacgggagagaagtgctggtcaccgttcctggcggtctttctccggatgctaccggtattgaactgaaaggtgcagatcttcgtccatttttcgggagtattccgccggggatgtcgggaactcccgattctgtatggggacagggaagtggctcggcatctatggccgttcgtatcgctgatggactcagacgtgaagcaccttacattgttatcgatgaggatcgtgctgcacagaacctgatggttccctgttacatgagccattccaaaatccggtcgcttgcgttcctgcttgcagaagatagagccgtatttggtgatacatcgtttattattgcaggatcaggcatggaactcttaatagctcaggcagaccggatactcagactttgtcagcaccagccatatgctctctctattctgaaatatcgggaaggactttatgagcattataaaaaaatggcaggaatggttccgaaaaaatcaggtgaaggtgatgttagcaaataattctgcctcctgaccaacataaggagaaggtatcaattttttcatcatggtcgttgcagcattcaggggttcctgaacctcggttgagttgacatctcctgaagtttctttggcaatctcagcactgcagaaatcctgatatgcctggcatattaatgcagtatcccgcagtctgaagagcatcttattcacagaaaccaaagagggaatggatgcatccggaagaagttcagacatcgtatttacatcgaatgatgaaaacaatgattgtgtattgtttaacccttcataggcgttatcatacatctcttttgcagccttgaattcctgaagtccggtttcataccggttagtttcattgcttaagatagcgtcatatcccttcaatttgtgatctccaccttggatcatgaaatcatatgcaacgagcagggtatcccataattgaatataatcagtcagtaatccggctgtatcactagttatctctcctgaacccgaataatccgaaatttgtccagtaatattggtaaattcttccctgacggtctggatgagctcccgtgattgttcagattcgtcagtaaagctaatcaggtccgcttttgtcagggcatccacaacagcagtctgaatatcatttgggatctgattatccgtagcagaaacaacccctacaatgaatgccataatgaggcctaattgtaaataaagtgaaatattcatcttaatacctcccaaatggattattatagttgccgcaacatcttgccttccacattccggcatcttcgtgatgaataacatagtttggctggcaatatatctgatacccggtacagtcacagattcccagaacacaatcaaatcctgaaggttgtggtactggggaagtagttggggtttttacagggggttttttgggctttaccggataatttttaaataattgtccaaatgcatctataacatcagtatatcctcccgggactgatcccaaaccctgggtaatgtccaaaattggtggtatcgagatacccgattttgaaactgggaaaattgaaggctccggtccatatacagcagtattgtatggatcatatcctcctgttcctatgccaaaggggtcatacccaatatcaatagggccactaccgatatccatagggccagatccgatatcatagggatcaaaccagtcatcatcatatcccccttcggtattgaatgcccaactcccttcaaattcttcatctgtttctgttgccagtaccggccctgttgccatctgaatcatgtggattattgcggtatctccggctttcacagaactggcggtttgatctgcacttatagattcattatcatcagtcaaccctgacgaggacattccagtcaataataatagaatgatcaccgtaatacccaacatactgcctatccctttcatacacgatcatgtgtttgttcgcataaaaaaagtattgatatgtttaacaatacaaatctcgcataattcgctgaaaatttggatactcgcgaaaaattaaaaactttcaatatgtcacaaaaaataaaagtattagaggtcactaataatatctgaacggtcgatcatcatgtttgattccgatgtccatgaggcgctttgtcaggtccttcagatccgacccgacgatacggtcacgggatatcgtatacaggacatcatccataaagagtgaccggagcaccgttgacccataccaccattcatcatctgacgaaccggttccctgtttaacccgccctttttcagtaaatccggtatccgggttaataccaaatacatatgtcccctgccaggtctcctcggtatgggatccttcatacgtgctaccctggaccggtatgtgaacaacctccctgatcggaattgccatgatattcttctccttatcaagcaggaacgcccggtggtctgaaaggacggcagagtcagatcccttctctccgatgacaatactctcaacaagtcgtggattattcacattactcacatcaaagagggctatcttcaccccggtcgggacaattccgccccattcattctccatggtgtcttttccgatgccaatcaggtgagtctcgtcatagggatggagataatctgaatatccggggattttcagttctccaaggaggccgggctgatagggattggagagatcaatcacgaagagtggatcggtctgcttgaacgtaaccagatagagcaggtctcccataaaccgtgcagagtagatcctttcatcaggagctagatgttcgagccgaccgatgatcttcagcgaagggtcaaagacatagacattactatactgtctggcatcagatgcaaagtcagatacagttgttgcaacccggagatttccacggttttcatccagggagaactgatttaagaggtatccaggtacagttcccgttgctttgtatgcgatgtcaccatctttaatcgcaaaccggtgaatgaccgactcctgctctggttcttttgattctgctgatttttcatcagttaggtaccacccgtaccagggtcgctgtttttcataggcaacatacacattctgcggcgatacatagagtgtatttgaatatcccagaaggaatgactcagccttgggctgccctgacccggtcaccggaaatgaggtcaacgtatgcatctggtactcattcatcagagatgggggacaccagatcgatgatatctcaattggttctgtaccgtcatagatgatgggcatccggggattatggtaatcaggagtctctttggtcagaacatagacataatcgccgatcatccgggcattataatatgttccaggggcagagattgtcctgacttccttcgggctcttccggtcggagatgtcatatatcacggcctgtgtctttctcgaataatcagggattggaaccgccgatcccttcggggtgtaccaatgctcgtcattcgtgtcagtaaagacgacaagacggtcccctgcaaggaaaagctctgatactgacccttttaccggcagttcagtcacgatcttcccctgctgcggggggaaggcatcgacgatggtaagggtatctccactcttgatgtagatatattttccatcattttttacaaaatccgcttcatcaactccggcaacctgaatgttggtcgtggaaaagtcacttgctcctttgtctgaacctgcagaggtcgtggcaggtgctcccatctcctttgcagccatgggagcaggtgccaataccatctctgggactgccatggccatatcataatacatcccgtttgaatagccataccggtattcagaggtgacattcttcatatactcttttaaatcctcatcggtggttatctccagcattccaggtgcagatgcatcggtgccggatacctggaaaagccctgcacataccgctatcaggatcacggcaagaaacagggatcgcattggtgcctgtggtatcataatgatgtaatatacctgatgagggtaattagttgtcgaaggcttggaaaattttcaaagtaatcttctaatcggaaaagtgcttttctgattttaaatcattattctggttcatccagttcatcttcgtagatgtatccctggttcatctccaaaatcctgctgacctgaatcgatctggtgggacattgttcttcacatgttgagcatccggtgcatttttcctcatggaacacgtgtgctatcccgttctctacggcaagaattacttcatctgtggttaccgttcccttcgatgtgagaaccgggtctgtctgccggttaatcggacatgcaactgcacaactaccacatccaatacatgtgaccggattaatccggatatgaatagaataattcatccaggtctctgatctggttgctttttggaatattcttcctgattccagtactacttccgggcagatttcaacacatagtccacatctgatacaatgacctggataaatatgggggttccataccgcaggccttcctgtttttttcacttccagggcaccaggagccggacagatcatctgacagagataacaatgggtacatgccctcccggtaatttccgggacaccccgtgcatgaagaggagtttccagaggctccgtgcgtggatgaagaaaattaataatccatttctttcgaaaaaagaattccaggtagttctgaatgaatcgcacaggtactccctgatgtacatgtatgcattcaccataatgaaagggttcgtatttcattatgaccatacccggatgtattaattcattcaggttgacatatatgtatgcgaaaaattcccctctatgagaaaggcggcattatcaatgaactcggaggagattactgtactgtcagactccgaatccctgctggtctgataacggtcgaccagatggagggtgttgtaaagattgccaggaaattcaatacccaggtgcatctgaccaccagacagacgatcgaactggtccatgttctccccgcttcccttggcctccttgctacagatcttgaagcaaacgggactcctgtcggggctgaaaaagcggagatagtcaatattactgcctgtcctgggacagacaggtgccggtttgccatgatcgactcaatatctcttgccaaaactcttgatgagaaatttttcggaaaggagatgccggtaaagtttcgaatagccgtctcttcctgtccgaattcctgtgtgagtgagcgcctgaatgagattggaatcaccggagtcgtcaggccataccgggttccgggaacctgtaccgggtgtggaacatgcgttcagtactgtaaagagaaggcaatttccattaaaaacggacagatacagatgaacgacgacctttgtgttcactgtgggatgtgtatccagtcatgcccgttccatatcatcaaggctgaaccggctgcatatcatatcaccattggtggcaggcgtggccggcatccccgtgtcgggtatcatattgttacggttaaaaatccggaaacggtagtcaacgtcattgaacgtgtggtaaagtgggtctatcgaaaagcctggagtgattcccttcttccggatcaattagagattctagactttgaatcttttaaaaaagagctggttggagaacttaatgaagatgaggtaatcaccgggtactgactaaataccctgatttttcgtcatctccttcgcatggggtatttttccgactgctgccatatatactgcaaactttttttctccatcaataccgattaggtggtttatttcatcatcattgaatgcacctatagcacagacaccacacccgacaacctgagaagataaatagaggttctgacatatatggcctccttcaaggaaaatatcacggaatcctcgttcaccatatcgccaggtcattcggtatgaattggcaacccagataaaacaaactgaggctttttgaatgcagtcctggtttaaccctcccttatagacaatctctggtatctgctgctcttcagatatagccccaagactatgttccagggccaaaaaccggtacaggcctgatttaaggccatgtacatctcttgcatacaggtaggtatcaattgcatgacgtgccccggctgatggaacggttctgaaggtacaatcttccattatccattttacgccctgtgtacaccagagcaggtacgataggtcttcgatagaaagaggggtgtcctgatatgttcgaatactctctctggcttctatcgcaacagatagatcaagatttaccagaagtcccgcatccggatctggaagagcgatcaccgtaccctcaaaatcatcttctaatggaggagatggaatccctctcatctgatcagtcgtaattgggcaggtatatcgtgtttttcgtatgaaatctactccaattcccattaaaatcctcttcttttatgatatcttcagtgctctttcagacaacatatttgcccgcttcttttcagattatatccctgtaaatgcccactttcacttctccattcttcagatgatagtatctcctgtaacgcgttaatttgttctgattgtgcatcatcctgcttaacgataagatcaatccgttcacttccaattactggtccaaaaagatcatattcagatgccagcgatgctgagcagggcccgaaatcaatcttttcctgtattatctgttgcactatctcaagttcggttttacattcaggttcaatcctttcaatgagcaacggatttatctgatgattgagaataaactgttcctgaatttcataaagaaatgaatgatccgggatttttggaaaggcaaattcttttaatgagtcataatttggaaatacagaagcagccagaatatattcacggtcagcaacagtaattgtacataatttttgatgagtgttggtatatccatgttccaatacattcagtccgttatttctggggcggataattatgccaccatgaaccgtattcttttgcatggaaagaagggtggattccaatgatgcctcacgaacatagattctcttattgagctttctgaggtactggtcaagaacgtcaaggataggatcatacatcccgtagaatagatagatattgtcaggtggaggagaacatcttgtcatatgaaccaggcttttttttccctttcctattccctcactatttcgggcaatatgcaggactgcattagatttcactgctgagatctggccaccttcgcgaggaaccatcattgctttatactcatcacctacctttcctacgaccatcagaacaaaatcatcggtacccagctcactcggtacagaatctgccagagtaaccggtatggaatggtggattggtacaggatatccgatatctgaaagccaggggataatcagtccgcggaggactgcaagagctcctgctggagttccggggactccaaagacaggaatatcctgaacaatcgctgcgagtgtggtttttccaggccgcatggcaactccatgatacagaattgttcctatcgcggtcaacacatctttcgtatgatcacgacatcctgttgaagacccacctgatatgataacaaaggaacattccccgacggcttcttccactgtatcccgtattttttttggatcatcgggtattatgggatagataaatgtttctataccaatagttacaagagaggctgctaacatctcacaattgcttgcaatcacctcaccagggcctggtgctgtacagggttcttttaattcatctcccgttgggattagtcccacaacaatttttttaacctgcaccgatgtaatcccatatccaatcatcgctccaatatcctcaggagaaatcacgtgatctgcaggaataatcatttctccggtcttgatttcacttcctgctttttgaatattctgccctggtcgtgctggttttagtatggttatgttgccattgacatcctctctgatatcctcatgcataactacggcatcaaatccttccggtatcggtgacccggtatgaacctgatcaaatacactcagttgtaccgggtcagaatccgatgcattgaatgtatcagaggcattaattacatacccatcccttttggatactgcactattcgggactgtaagcctggagtatactggttcatggcagatatggccatgactttttgtaacctgaatcgttctgatcaggtatctaggtttcgcagacgtcttcagaattctttgtgcagcaaggtacgggatgagcgttaaaaaacggctcaccagagcctcacctctacctcttcaccctttacaaggccttcctttcctgtcggaatatggataattccatcactatggaggagagtatttaacagtcctgattttccaagaaccggtgtagcttcatcgttttcaatacgtacccggatatactgctcacggcctccttctgacttgaggtccgtcgccatttttatagtctttttgtaaatatgctgacaaggtgctcctttcatggcctggatcagatgaacggcaaccaaagtcattaccatgaatgtcgataccggatgacctggaagaccgattaccgggacatctccgcattgtccgataatggtaggctttccaggagcaatggaaattccatgcacaaatactttaccaagtgatgcaatcgccctgaaggtgatatcattccgatctttggagctgcctccgctcacgatgactgcatcgcattcagaggaagcggtttcaatcgtactttttaattcatcaagattatctctgatgattccgtacctgaccgggattgctccctgttttcgtaggaaaacagatatcaggtgcgaattcacctcacgaacttcacctgtccgtggtatcgcctctgcaggaaccagttcgaccccggttgatataatggcgattcggggattttttcggacggaaatccgcgttttcccaattgcagcgagaactccgatatcctgtggcctgagtgtcgaagcgaccgggtaaataacggttcctgcatgaaaatcttcatcttttgcaattacgttctcccggacaacaaccggttggcgaatgaggaccctatcaccaacctgctctgcatattcaatcataacgactgcatcagcaccatccggcatctgaccaccagtgggaatatacatacattcccctgactgaatctgccccttctttgactttcccatagcaattgaaccacaaagagaaaggatgaccggagaattttctgtcgctggatatgtgtcctgtgcaatcacagcatatccatctttccaggatctgtcaaatcccggaatattctcctgtgtgatgattgattcggctaaaacccgaccttcagcttcatcaatcataatcgtctccgttccggtctgttttgcaatgcttcttacagttctgactgcttcgtcaattgtaacaacatcaaaaaaaggttctgccttttctgaaagaaaggttctcgatttattccctttcccaagtcctgagccagtatcatgtccatgtaccgtatctgacaatacggtatccggtccatgggggtgactggaggtgatcttcccgagtgtactgttcatcaataataacttattcttcctgataattaactatttcaattcgaaataaaactagaaaatctcctttaaggaggcataattatattgaaatggtcatcaggaaccggttcggagctttctcacgatcggtattactggatctcaaggtaacctgatgaccgcaccgagttttgctgacaagagtcagcaccacatatatgatagaaagagtatttaaaaatacttattttcatttacgatatctgtgatttaattaacttatttaattttaaagaaaaaatggcgaatttaattagcttgataccgtttttggatacttcaaataacaaattttttaaaatcaccataaattgcatttttttaatataattttgcatcgtactgatcatgtggatgtatatgaaaaggtgatcgaatcatggtaagatccatgacttccacctgttcaccctttttaactcctctgcttccctgagggatgtggacaattccgtcgcaatgggtaagtagactgacaagacctgctttccggcttaatgaaaagacatagccattgtcaatccgtactgggatgtgatactcacgatcgggatgagctttcatgtcatctcctgcgattgcgtgttcttttaaaaggccttgtgtcacagaacctttcattgcctggatgagatttgaaaccacaagcaataacaacaaatacactgatgccgggtgacccggcagaccaataatcggtttacctcgaattgctccaattaccatctttttcctcggagaaatggacatacctgacaagaggatagatccataatgtgagattacttcagccgtacgatcacgctcatcatgggcgcttcccccgctgataatgattgcatcacattctgaaacagccgtgcaaagcatgttagatagatcagccatcccctcccaggcaataccataccgtttgggcagagctccgagttttctgcacaatgctgaaataaggtatgaattggtctctctgacttcccctctcttaggcctcccatctgcagggacaagttctggcccggttgaaaggattccaataaccggcatggccctgacctgtacagtacagattccaaatcctgcaagaactccgatatcctggggacgtagtatctttccttcagggaagataatttctcctgctttcgcatcttcatcctttctgatgacattatctcccggaaccaccgggcagtaaatctccacgtatgtttctttaaaacaagcatactccaacattacaacagcatctgaaccatttggtaatgctcccccggttgtaatgcccatacaggaccctttcgtgaggatatgagaaggtgaatagccgttctttatcgatcctgaaaaggttaaccggatcgggttttctggtgtggcatctttagtatcttcagcccggactgcaaagccgtcttttgttgagcgatcaaaacccggaatatcatatctgcaaaaaaccggagctcccagggtatagccatcggcttcatcaatatatctggtttcgatttgcgtatccggagcaatttgtcgtatcaggttgacagcatcctcaattgaagctgaacatattggtacagtgtcaaaagaactgttctgcgtagtattttgagtctgattaaaagtacctgataaataaatgtgttttttattctgcatgaattccatacatacccgagttttatacatgttcatttcacaatacgataaatactccatgatagttgtgaccggatttgggaatataatgatccatgtagccttttgaaaaaatcattttccatggagataattttaaaccaaggtccttgaatgaggatcaaatttcctagtgattttcaggatcattttcggatactctgtattactatacttctctcgccctttgaatgtaatttactaagtaggttttcgcatgaaatgaatttaatgtcactaactttaatcaaaaagaaatcattatatgttatcagttggctagtagtacagatgaagtatcgatcatgtctcttaacaggacttgtactcttcttcctatttgcgttcatgtctgctccggtgtatggagctttagagtctgatacactctttgtgtatgcgggagctggactgaaagagccgatgacagaaatcggaaccttctttgaagaaaaaacaggtattaaggtagaatataatttcgccggatccgggactcttattactcagatggaactgaccaaaaagggcgatgtttttattcctggtggcactcctgattatgcaatcgcagagaataagagtctggtaattgatccggtgtatgttgcctatcatgttccggtgatcggtattcaaccaggaaatccacacggaattaagtctatttatgactttaccaaagatggactcaagctcgcacttggtgatgtgaatacaacagctataggaagacagggtcagaaactttttgaaaaactgggtattgctgaggatgttgagaaaaatgtcgtccttcgtgcacccacgataaatgaagtggtaactgcgttaaaactgaagcaggttgatgcaagtctcattaccattgaccagataaaaggagatgagatagaatccgttcaattacctgatgacgaaagccttgcacttgttgtacccatcggccggaccacctttactacacagaaagagcatgcacaggaatttgtagactttgtttcatcagatgaaggaaaggcagtatttaaaaagcatggtttccctgtttatccggacccagcctatgctgatctgaaggtatgagtgaaaaaacatatgattttattaaaagggatattttacaccctctttcctgtctttttgaaagtaccatgcaataaaacctctcactccataaaatccagtcgtccggattcgcatgcatatatggttttggtaaacaagataattcgaaaaattacattctgtatcccgaatccatgaaagggaaatttaaggtgtattctggcttctggtttcagggttttctaattctcctctctggatctctgatactcctattctgcctggtatttacgagtctcgtcctctggcctgacacacatgcccttatccgggtactaacttccgaagagattttgttttcgattcaactgtccctgatcacatcactcatctctaccatattctgcgccgttattgctctccctgttgcatatgcactttcccgataccactttccaacatcaggattcatgggtatggtcatcagccttcccctctccctcccaccactggtcgctggtattgcccttctgatattcttcggaccatcttttttcggtaatattctccgctttatcgggattgatattgtgtataccaccaccgcaattgttatcgctcagttttttgtaaatgttccgtatctaatcagagtcatgcggtctgcttttgattcagtacctccccggtatgagcatgtggcaagaacacttggagcatctgaatctgccgtatttttgcaggtcagtcttcccatgtcccaccaggctcttcttgcaggacttaccatcacctggtctaaagccatgggagagtttggagctgtcctaatgctcgctggtgcaaccaagatgaaaactgagacattgccaatagccctgtatctgaatatctcaaccggggatcttgacctggccattgcgtcagcgaccattttaatggcaatctcggtaggaacattacttgtctttgaacactggtttggagtaaaaaggaaggtatagtgccactagaaattatgggattatccaaaaccctcggtgattttcatctcaggaatgtgaccctgacaatagatgatagtgaatattttatcattcttggaccttcgggagctggaaagagcctattactcgagactatagcgggaatttattctccagattccggaaagataattctggatggtactgacataacggatcggccggcacgacttcggcatatagggatggtataccaggattacatgctttttccatatctgaacatagagaaaaacattggatttggactgagacaactcaggcacccatctcatgacatcagaaaagcgacggaaggtattgcttcacttcttggaattacccacctcttatcccgtcgtccggataccctaagtggcggagaacagcaacgggtagccattgcccgtgcccttgtcataaaaccgcggattcttctgctcgatgaaccattgtccgctcttgacgccatcactcataaaaaaatgcgaaatgagttagcaagaatccctatgcttacaggtgtgtctgtcattcatatcacgcatcatgcagaggatcttatctcacttgggcaccgaacagcagtcatggacaatggagccatcgtgcaaattggaagtcctgatgagatctttcaaaaccccaaaacaccctttgttgctgccttcaccggaatggaaaatttattctccggtattgcaatggatagtcatgaggggaaggtgatcaggattggtcaggtaaaaatacatgtcatcaccccatataccggcccggttcaatgtggtatcagacctgatgctctcatcttttcacgcgaacctttgaaatccagtgcacgaaatgtcctcatggcaacggtaacaaagataagacgaatgggatccattgcatgggtagtaattgattgtggaattttcctaactggtgttctaaccattcagagtttgtacgaactcaggattgatgagggggataccatctttattgcattcaaggcatcagcggtaatggtatttcccgaagaaacacaaaaaaaataaaaaaaaaaagattatctcttgagtccgtcgataagacgtgagacctgcatgggtttcatgtcaatatcaaaggtatcatagatgtaggttctgacctgctggacggttggctcctgacctttgaatgcttctttaacctgttcaagttgtttgtcggtcaattttttcttgctttctgcacgggctgccggtgcagcggcctcagccttgccggatggaacgtagatctttccatagatgatctctcctttccgctttccatgccgctcgcccatgtcaccaatccagacctggaacatctgttttttaccgtcgagttcgacttcttcctcacccttcaggatgtaggtgggcatcatccgctcgacctgaccaaggacaaagatgtctcccttgaccatctgaccaccgacacggccttttgcattgccacggacgatgatcttaccgccttctgcatgggttcccaggtgaacatcaacattgccgccgatatcgatggtaccgccgttcataaaggttgcagtatcggatcctgcgttgcccttcacgatgaccttaccaccctgcatccctctccagtctccacggtatgaagctgcaaggtagttctttgcattcccgtcaacgatgaactcgccaccggtcataccaatggcacagaatgagtcaacatttcccttgacatggatcttcccgcctgccatccatgccgcggtatacatgtctgtattgccctgaacctcgatctctccggcggtcatcttcataccgatgtacttgaccttgtcagtcggcccggagatgatgatcttggtgtctgcagcagtggctcctcccttcccttctacagtgaagtagtcgctgatttttgcagtggtgtttccgaggtgaacgtgtaattctccaatctgctgtgcagtcttacctgcaaagtggtcaggagtgatgttttctgcttcaaggtacagttcgggaactttcgtgagggtaagttttactatatccattccttgtcactccttagttggaatctacctcaatgacgtacggatttggtacgtagtggtttgatacctcgtagttgttcaggttcatactgtagaacttgaggaacttcatctggacatcccgttctacctgttcgttcatcgggactttggcatcaacccagagggtacgcttgtttccgttgttgatgacttcaccattctctacaacgagggttccactcttaaagacataatctgctgcagagaacgccttctcgatctcttccgcatccttgatcttgtcttcgttcaggtcatagacgaccacatcggcgtccattccaggggcaagaccaccaaaggtgtcatacagaccaagtgatttggcaggtccggctctggtcatctgggcaatctcatagagggtcagttcacggtcgatggaagcaaggttggttgctgcaatgaccttgtcagagttcttaaagcccttgagcatggcctgacgtgacttgtcagacataagccacttcatgatacgcgggtaccgggtgaatggtcctgcattcgggtggtcggtggtgatgaaggttctcatcggatcttttgcaaggagaccaagttcaagaccaattgcccactgaatagcgcataccttgatgttcgggtcgtacacgtagggaacgataccagagctggtctcaagttcgacatccacatttgcccacttgaggtggtttaatgaggtaaggtggtgctcgaacggaccgtcggcggtcatggtcgtggtctcatcaagggtaacacaaccaagatccatggtcatgttcttgttcttgttgaaataatccgcgatctcctttgctcctgactcaaagtttgcccatgagtcacccttgtagctatggaactgaacgtgggtatggtgaaggacctgttctcgaccgaacttgttgtttggtttgactccttctgcaatctttaaggtatcaagggttgtggtatagttccctggatttccaagattgtttgagtggatgtgaatcgagtgtggaaggcccatcttctcgtttgcagtcagaagaccctttacaatctctgcgggggtgatgtcaaagtacgggaccggatcattgacggttgtacagttctctccccatccccatgcttcagagccaccggggttgacgatcttgattgcatatcctttggtagtcttgagcagccaggagatgtatgcacagacattgtccatctcgttgtttttcaggtactcaaagacgaaccagttatttccaaagaccgggaatgctccttcgtcgatgattggagtgtccttgatctcttcatggacgtgccgtgcataaagtggcggcattgcagcttccatgacggtggtgtatcccatccgggcgtattcatacccggtcttgaaggtggtcgggattgagaacccgcctgacatacgggtgttctttccggttggcttgtaggtgaagagtttgtcttccggacggtagtttcttccttcgttgacttttggaccggcgacgtgtgcatggacttcaactgcaccggccatgaccgtcttgccctttgcatcaattactttcgctttattggagaccttgtctgcaatctttccatcctttatacagacatcggcaacatctccttttaatccagtctttgggtcgtagacctttccatttttaatgatatattcgctcatgattattactcccttaatttgccttgagttctttgaccctctttaagactgctttcaggaactcctcatcggtcatcattccttccggtggttcgacaacttttctggcttcaatcgggacgttatccatacgatagcagttgccaccgacttctactcccacaaaggcgaccgggacatggactttgcagatggcggtggtcggagtgatatgcgggtcaattgcgactgatgggagccgggagatctctttgacacattccattgggaagtgtgcaccagggtcactgcccaggacaaacatggcatcaatctcctttctcttcaggacttcgatggttccggtctcacctgggttgtaccgtgcaaaccctctggagaggtcgacagagtatgggaatccgaactgccagccgaggacctgacctgaaccggtcacattatagtgtcctctcatggctatgatggagaacttggtgtagtcattgaggtcttttgtcagcatgatggctgcatcgatgttgtgatcctttccaagggactgggtcactcccataccgaagaagatgactccgaaccggccggactttaagagttcagctgcctcgtagaccttttccttcgggactccggcgataatgtctccggtcagttcatttccacggactgctgcacggagtgcctggagcaattcatagtcatacccctgttcaacctgaaggtgaacatctgcaaggcttgcggtatcggtcggacgtggatccacgacgatgatctttctctgtttctgaccctttccggtgaagtaaccacgggggaagatggaataccgggacatatggcgggggtgggcatgagccgggttgcatccccagaaaataacacgatctgcacggttcttgacttctccaagggtacagcttgggatacctacattctgcactgcaataagggttgttccgtgacagacggcagcggtattatcgacgagtgcaccacagagttctgcaatctcatgtcctacactctgagattcacaattggttgaggaccagccgtacatagatggctttttcgcatttgccagcatctgtgcggtatattcgatggcctcatcgtaggttatctctttgaaggatccgtcttcctgaagtttctgcggacgggttacccggtgtgagtgatcagatgcatgaaggaatttctccgctccgatggcgcaggcattctcaacattcaggatcttttttccttcatcatctgtggtgacaatcagatcatcgcaaagagtcccacaaaatggacagatgacatcagtacatgtttttgacattatgcatcaccccagcacttagccctgacaagttccaatgagttcaggactttttccttctctgctggttcaatagtaatcgggactcctttaaaagtgggcataccggtgctgtacgtttcagggctggtcacactgtttgcccatggtcccatggggatgaaggcaacgcccggatgcggcccctgggttgcttcaattgcctttacgacaacttctccatattcactttttaccttgacattggtatttttcatgatgccaaggcgtttaaagtcagaatcatcgatctcaatgatcccgcaggctttcatgtatttgtcagtctcttttccgccttccattgacgcaccctgctgaatggtacgtccggaaatcagattgatggaaattgtgctcataatgctcctcgtaacgaagaaaatcgccgatgaacagtcatacgaccggatagccggttatatgatgcatgtcccggaacatgcagacctgaagtactctgatagtcccgtgataacagaaattttctcttttcactatataaattcattgttttgctttcttcaaaatgatgatttattggtgaatgagcaaaaaaagttagcataataggcattattagaaggattataaatattataattaaccccataataatgataaaaccacgcaaaatttatgtgcaacattagaagaattaacatcaaaaaattaactccaatccatggtaaaatgcattcttatgaagttccgcgcattatggtgattatcggtgaaaattcgtcattctgttattgattcatggaaaattgtgaagatgttaataattcgtttttaataacgaaccctaaattgagattacaaaccatatagaaaggcagaatcattcatgaaggaagaactcgggaaaatccttcacgaattcgggttgattctgcctctatcacgttaaacatgtgcccggtggtatatccgagcaatacatcatagagagtatgacgtgataaccgtatcggttttctcacaaattatggtgaaaattggtgaaaaaaattagggaggaataacctaatttagtttacttatatctatttttagtcatacatattaatattcactatcgcgtgaatagttgatcacttatgctataataatggtgaaaatattctaaaagtagtttactacctactccattgttatcagtataaattatggtgccgcaaaaatgttgattattggtgagatactcaacaatatttttacataattcatttaacatactgcataatcaatagaaatggatttattattagaatgatgaaaattctctctcgaatgtttgtgatcatttctgaagaggtaaacatatcaattagtatatgtcttgaagtcaaacattaattacatgtccaaactcggggacgaatactcaaaagaggaaattctttctctgcttaaaaaaaatgggagtgatcctaccattgttaactggttcgaccagtgtattgattttcatacatttcctgctccaggtctgctcattggcatttatatggtcgataaggctctcgagcttctgggggcaacccctggagagaaattgtatgcagtgtgtgaaacgacgaaatgtgcaccggatccactgcaggtaatcactcactgtactaccggaaatcatcgtctcactgtcatcccgatcggtagatttgcacttacaatgaatcgtccgagttcagacgatcatgctgtgggctttcgagtaaaggttgatgtgggaaaacttgatggaactccaacacttaaagcatggtttgctaattcatcagattttgatggcatgactatgaaaaagaaactggtggaagaaattctggatatcggaaccggaatgttatcctgggaaaaagtccggatacctgtcagccataaaaagaaatggaagacagttatctgtacgtcatgtggtgaacctgttccggacaaccttgttgaaaatggcctttgtcccggatgtggaagtcagaaatattacgaaaaaatctgacataaataatcttcgggatagtaatctcgctctctttttttgctgttccctgttactccaatggtatatgtgttcgctattttttttggggaggagagtactgatcagacggcggggatacctccgaaatacgataataatgtcttctgtcttctggataactttgctgggaccaccaatgggtgcggtgatgttatcacatgaatcggtacgagttcagttattaatgcatcaaatgataaaataccctcaagatgtgcctgtccaagccgtttcaggataaaagtcttcatcatcaccgataaaaaacagataaaaagcatacccatctttatccgttcagtctggtgcccttcaagatcccgtttgaaatcacgatagagcgagaaaatatcccgttcaattttccatcgtgcatcagtcaataggaagcattcctcccaggaaaaatctccctggaacatgacaagagaacgtgacaatctgcgaatctcatttgtaatcatcttttgattccttttaacacccttattattgaataccgggatgaaaaattcatgttccattcccgcgacctcaaaaattagttctgtcagtgaagctggatcattctcaccctgaataatcatatcctggatattttgcagatttttttcaaatacatagcggatcttttgctctttttttaaattgtgaagaatatatccacggaccggaacatatccaactaaaaccgtacactcttttaaaaaacaaggttggcccatatatgaacactcaatacccggactagtgtgttcatcccaatccattatcgtggtccgtgcgggatcataggtgatgtcgggtctaataataaaggggtacccaattgaggctaaattttggatgaggacaggtgaaaagtaatcccagtttggtaaaagaattcctcctggtattctgcctgaacttataatacttaatgattcctcaataaaattccttcttatatcggtcatttcacatccggtaaggaccctgagttccggatcatatatcatccgaattcccaagtccccttcaagcagatctttataggaatacccttctccccgtgaccccttaaaaagggaataatctgttactctcccggacataatgatacgtttgtcagaaaaattgttaatcatcgagaacatgcgagaaaaaagtccaattaccggccgattcgagatagtatggagaagttggaagattgaaataggatcagcaatcactcctggaatcaaatgtgaaatccaggtaccagagagccatgaatttacctgccttatagaacagggaagaataagccggtttattgccaaaaccaggaggagtgaaacttcctcaggagaaaaacagcttaaaagtgcttcaaatagtttatactcacggattgcccaatgagccggtatatattgtccaaaatcatacacccccccggtcttcgggatacgtgtctttctgactggtgcaccatcaatatttcgtcccagatattttgttttctgtttccatttccctgaaatttcgtcaaaatagggggtaatttcatacagatattcatgacctttgatcttctttttcctgataaatggtttcatgtctgaatcgatattgcgtagtgcctaactcattctttggtttgtatcgactaataatgttttgaacatcatgtagatttgttatgcttaattttttataaagtaaattgtcatattcaaaattcaggttagggcttaattgttgaattatttttcaatttaatcttatcatcaggttcacattgccagggtttcctgacacaaccagatccactttccttcctttcaaggacattttgtttttcgtcgatttattcacctcatgtcactcgaagaattgatgcctaacttcacatttcgaatatgttcttatagagatatccaaagaatacatgatacgatcaggattcatgccctgcctatcggggaaagggtacatctgcctgatcttatctgcaaaaattcaaaacagttcgggtgttttgaaaaatataggattttcgggagatcctatgaaagcaaaaaaaacgttaaacatgataacccagcgggctgttgaagaaggtattgccatggagatcgggaaaacttcacggcagtactttgacgcctgcagcatcatcgagatgaacgaacaggacatgaaagaacttggtattatgaaaaataccaacgtccgtgtaaaaagcgaatccggtgaagtggtggtgaaagcagtcgttggtcgccaaacctgttatcctggcctttgtcatatcagacaaggagtctgggcgaaccaggttgttcccccacgaacccagtcaaccggtgcaccccagtacagtggatttccggtaacggtcgaacctgttccaaatgaacggttgaaaactgcccttgaactggttcagggtgctgtcggtatgtggaagggtgaccaataatgccaaaagtaatagaaaatgtcggatgtccctattgcggatgctcctgtgatgatgtccgcattactgtttcagacgatggaaaggacattctggaagtagaaaacgtctgtgcaatcggaacggaaatcttcaagcacggttgttctaaggatcggatccgacttccccgtatgagacaaccggatggctccatgaaagatatttcctacgaggaagcaatcgactggactgcacgacatctgcttaaggccaaaaaacccctcatgtacgggtttgggtctaccaattgtgaaggtcaggcagcagcagcacgtgtaatggaaattgcagggggtatgcttgataactgtgcaactatctgtcacggaccatcgttccttgcaatattcgacaacggatatcccagctgtacactaggagaagtcaagaaccgtgcagacgtgatcgtctactgggggtctaacccagcacatgcgcacccacgtcatatgtcccggtactctatctttccgcgtggttttttcaccggaaagggccagaaaaagaggactgtcattgtcatcgatccccggtttactgacacagcaaatgtagcagattatcatctccaggttaaacagggtcatgattatgaacttttcaatgccttccgaatggtcattcacggccatggaaaagaccttcctgatgaagtcgctggaattaaaaaagagacgatccttgaagttgcagagatcatgaagaatgcccggtttggaactacattcttcgggatgggtctgactcatactgatggaagaaaccataatatcgacatcgctatctccctgactcgtgacctgaacaagatctcaaaatggaccatcatggcaatgagaggtcattataacattgcaggccctggggtggtctggtcctggacattcgggttcccttactgtcttgaccttaccaaacagaaccatgcccacatgaaccctggtgagaccagttcggttgatatggccatgcgtgatgaagtcgatatgttcattaatatcggaaccgacgccgctgcacacttccccattcctgcagtaaaacagcttaaaaaacacccctgggttactattgacccaagcatcaatatggcatccgagatatctgatctgcacatcccagtctgtatctgtggtgttgatgtcggtggtatcgtctatcgaatggataatgtgccaattcagttcagaaaagtcatcgaaccaccggaaggtgtcatggatgacgagactctcctgaataagatcgctgaccgtatggaagaactgaaagcgaagggtgaagcctgatgtcagaacttcttattaagaacgggtatatatttgacccaatttcaggaataaaaggagataaagcagatatcgccatcaaagacgggaagatcgttgacaaggtatcctcaaaggcacaggtcatcgatgcatcaggaaagaccgtcatgtctggtggagtggatatccatacacacgtatcaggtccgaaagtaaacacgggccggatgatgcgtccggaagacaagtttttccgtgggtcataccgtggcgggattataaaacagggtaagcgtatggagatgggtttttcgattccgtccacatacaagaccggttacgcatatgcccgaatgggatacaccttcacaaacgaagcagcaatgccaccacttctggcaccacacgtgcatgaagagttccgtgacacccccatcctagaccaggctgccatgccggttttcggtaacaactggttctgctttgaatatatcaaaaacaaagaacttgagaacaatgcagcatacgttgcatggctgctcaatgccaccaaaggtattggtatcaaggtcgtcaatccaggtggaaccgaagcctgggcatggggagagaactgtacaaccatcaatgatccggtcccgtactttgacatcacccctgcagagatagtgaaagggctaatagagacgaacgagtaccttggacttcctcactcagtccacatccatgggaataaccttggaaatcccggtaactacaaggacaccctggacacgcttcgtcttgccgaatcatacaaagcaaagaataaattcggcagagaacaggttcttcataacactcatatccagttccacagttataaaggaacttcctgggctgactttgagtcaggtgcaaaggaaatcatggattatgtgaatgccaacaagaacatcacatgtgatatcggacaggtcactctagatgagacgaccacaatgactgctgacggtccattcgagtatcacctcaaccaacttaatcacatcaaatgggcaaacgttgatgtcgaacttgagaccggctctggtgttgtgccctatatctatgacaaaaatatcaaagtatgtggtattcaatgggcaatcgggcttgaacttgcactctatgcaaaggacctgatgcgggttcatatcactaccgatcatccgaatgctggaccattcactcggtacccctgtgtcatcaagtggctgatgtccgagaaagcacgtaaagcaacccttgacactatgaagtggaaagacaaagtcattgctgcaagtaacattgcctcaatggaccgtgaactcggcctttatgaaattgccatgatgacccgtgccggccctgcaaaagccctcggacttgcagccatatatggtagccttgtaaagggtgcagacggaaacgtggcaatatacaaccttgatgcgaatgatcttccgtcagatcctgaactcatcgaagcggccttccagaacactgcgtataccatcaaggaaggtgtagttgttgttaaagatggagaaataattgcagagccgcataaatacaccctctggacgaaagtcaatatgcctgaaaatgcacaggttatgcatgacatcaaagagaaatttaccaagaactacactgtgaatctagaaaactatgcagtatttgatgaacatgtgcacaatccacgggcaattgaactggatgtagcataaaggaggaatgaagaatggaaaccataacaatgactcttgtacaggagcctgaattattccttgaatgctatagtgtcactccggacttatttgcaggaaaaagccttgcagagattgcagatcttccggcacatgaaggaaagattcagtggaaacttggagatttttttaaatttgaaggaaaggccggtgaaaccgctgctgatacgaagatcgtggtaaacggaaatgtgcgccggatgaagcgatttggacagcagatgactgcaggtgagatcatcattaacagcgatgctgatatgtatatcggtggctggatgaaaggcggtaagatcactgtgaaaggtaatgcagacagttttcttggtatcgccatggaaggtggagagatcctgattgaaggcgatgcacagaaccatgttggcagtgcttatcgtggagactggcgtggtatgagtggtgggcttatcagggtaaaaggaaaagctggaaatgatattggcactgccatgaccggcgggaccatcatcatcgaaggtgatgcattcatccatgtcctcacccatgcagaaggaggcaccgtcatcatcaagggtgatgtcgagggtcgtgtcggtggccagatggttaagggagatgcatacatccttggtaatctgctttacccacttcctggttttaagaaagttgcaaccgttgaaaaagaagtcgatggcgcaacctatacctttgatcaattcatcggagaccttggtgagcgaaaggaaaagaagaaaggtgaaattatttacgggaatattttccttaaaaaataaacttttttatgtatctaccttatatattcctataattatttatttctgcagaatcagagtgttaaataaaatattttttatttcttgaaagttcaataatgtgatacaccatgagtgatgagatacacgagatcctgaaaattcctgacctgccggttattgagattgtagatgacctggtgcaggtgttcaaagaatttatggtcgtgaatgctgctttaaaacttgacctgttttcatggcttgcagaaaacggaccggcaactcctgaaaaattggctacaggaaccggaatccgggcggaatatgtaaccagtcttcttggtatgctctattaccttgatatggtcagaaaagcaggggatgagttctcgatatctcctgctgcccggatgaatttcgtcagaaacagtcctttttaccagggggactatatcatgaatctcccggcagacgattcaccatggaaggatcttgctgtgtatctgacaaagcctgaacagaaaacgacatttgatacgtcttctctccaggcagttcgatcagaagcaaatcatgctctccgcggaacgattcagagtgtgacaaatgtactgaagacatgggataggttttcggatgcaaaaaaatttctggaaatgaatggaggacatggtctgtatgccattgcggcctgccagaataatccgcagatgacagcaactgttctgaccggatctgctgacccctcggttgccaaagagtatgttgttcgttttggtatggaggaccgtatccgtgttctacctggcgatttatctgtatacaccgatcagggatgtgatataattctcatcgctcatgctctctatagtatgattgacagacttgatgatgttctctcaaaggtgtcatctattctgacgccgaatggacttttaatctctaatcactggttctcacggccgcctattggtactggtatgcagggattatatgaactggaacttgccatccacaaccattaccatgaactgccggataaggaactttttgaatctttgtgtttgaaacacaatcttcccattcttcaggctggagtcataaggtcccggtatggggaatcaacaattcacatggcagaaaaaaagtaatatatggagatatctggtatgagcagacatgaaattgagaaattcactccatttgaccgactgagcgacgaagaacttcgtaatgcaatgattatgcatatcaggatgggatatatcctgaaattccctggaaaatccaaggatgctgaggatgttgccagggggattgttgggaagcttacccttgagcagatgaaagaaattcatcctcatacgtttttcactaataaaaacgggagcgaacgccccaaaaatccatatgatcttgcaatggaactgattcagggatagataattcctttccgctgtaaaaaaaatggttgggctctgatatatgatacctgataatcacttcatcatgataacccagagatcaattgaagaggggattgctatggaaaaaggtaagcaatccaaagagtattttgatgcctgtagtgttattgagatgaatgaactggatatgcttatgctgggtatcgaagaaaacactcctgttctggtaaagagtgagtgtggccaagtggtggttactgcaatcgttggtttgcagatactcaaacctgggatgtgtcatatcagacaaggggtctgggctaatcagattgttccatgtagaacccaatcaaccggtgttccacaatacagtggttttccggtcactattgaaccggctagagatagaaatgttttaaatgtttacgaattactttattcatctcttggggttacgaggtaaaaattatggttctggtccgtgagggaatcggatgtccttactgtgggtgttcctgtgatgatgtccggattacgctttcggatgatgggaaaaaaattctggatgttgaaaatgcttgtgcaattggaacagaaatttttcttcatgcaacgaatcaccaccgaataacccatccacgaattcgtcaaccagatggaagttttaatgaaatttcctatgaaaaagcaatagattttgtagccacagcaatcctgaatgccaaaaaacccctgatgtatggatttggttcaactacttgtgaagctcagggtgctgctgctcgtctcatggaactaggaggtggtgtgcttgataattgtgcatctatttgtcatggcccgtccctcatggcattttttgataatggtcacccaacttgtaccttaggcgaagtgaaaaaccgtgcagatgtcatcctgtactggggggcaaatccagttcacgctcatccccgtcatatgtcacgatacgctatctatccgattgggttttttacagggaatggacatcttcggcgaacggttattgttgttgatccgagaaaaacggactccgcaggcactgctgattatcatctccagatagaacctggcatggattatgagttaattaatgcattccggatggtgctctatgggtttgaatctgatattcctgagatggttgctggcatcccaaaacagtctattctggaaatatcaaaggtattgagggaagcgaaatttggtgtctgtttttttggtatgggtcttacccataccgatggccggaatcacaatgttgatattgctatctcattgatgcgtgatttaaacgcagtatcaaaatggtcaattatggctatgcggggccactttaatattgccgggccaaatatggtctggtcatggtcatatggatttccttattgccttgatctcaccaaaggagaacatgctcatatgaaccccggagaaaccagtaccattgatcttgcaattcgcgatgagattgatctttttatcaacataggtaccgatgcagcggctcattttcctattgatgcagtcaggcatctgaagaagcatacttggatcacgatagatccaaatatgagtatggcagcagaaattgccgatctgcatattcctgtagggatttcggggattgaggtttctggaattgtataccggatggataatgttccgattcagtacagaaaagttattgatatgccggatgggatgctctctgatgaagaggttctgaacagaatatctgaaaggttggaagagttgatggaatcagagcgtgtaaaagcagaggtgccggatatatctcttcaaaaaggcataagtcctgcacctggttttacccagtcactcatataatctgtttttaagaggctgttgcatgaataattttcattagcactataaggtcaattcgccctgtgaacttttggattcacaatgttaattttccttattgtatcactaaaaatgatttgtgcaacagcctctttaatcaggtgtataacctgaatctgcttttattatttccaagtctattcaggtatcaagagattagtaagttaacacattcagcttagcaaatcacaaaagatctattttttaaattcattaaatatacttatatgggaagttaatgaagatttgaattaattctgggagaaaccaatgacaaacaaaggactatacgtattcttttttgtggtatgcataattttgctaggcatttcactggtatcagcagacactcaggcatctgaacgggtgatttctgatgctcttggcagagaacttactatccctacagagatcaccggagttgtaagcactgccccacccacaacaatgaccctgtacctgattgcaccggatctcatgcttggatggaactctgaactcacaccgctccagaaaatgtatattcctgaagaataccagagcatccccgtcgttggaggatggttcggtaaaactgacggtaattttgagacatttatcaaactcaatccggacatcatccttgaaggcagaaccatcaccggagaaccaactgatgtacatgccgttgaggagagacagtcgcaattcggctctatcccactcattacaatccaggatactgcaaacatctcaggatatgcaaaatcgatctcctttatcggtgatatcctgaacaaaaaagaaaaatcagatgccctggttgcatattatcagaccgctctcaaaaccgtcaaagatgcagtctcaacgattcctgaaggagagaagataaaggtctattatgcagaaggaccggatggtcttgcaaccgatccaagtggatcccagcatgcaatgctcatagactactgcggcggcaaaaatgttgccgagacgaccatcacacccggttatggtatgactcctgtctctcttgaacaggtactcagctggaatccggaggtcatcatcgccagcgattctaaattcgcatcatctgttctcaccgatccgctctggaaggatgtcccggcagttcagtcaggcagagtatacgcagtcccccttacaccattctcctggtttgaccgtccaccgggaacgaaccagatccctggcctgtactggatgctccacaccctgtatccggaaaaatttacaaccgagcagctgaaagagaagattactgaattttattcatcattctatggagtagaggtatccgcatcacaactggatggtctgctcagtgatgttccggtttatgaatgatgacatatggaacaaaaagatgaccaaaaaatgggaaagaaagacagcaaacattttttaacgattgctgacaccattttttctcccatttatcctgttattgcagagcagattgtcacgaacaccggtattcattccgggacagcccttgatgtcggaaccggaccaggacatcttgcaaccgccctggctcttgcatctgattgtacggttcacgctcttgattgttcacctgacatgatagagatctgtcaaaccagggtttcagaaaaaggactaaccaagagagtcattccggcactgggggatgtgagtgaaattccttatggtgataatacctttgatctcatcatcagcagaggatcatggtttttctgggaggatttatcaaaaagccttacagagatttaccgggttctaaggcctggtgggaaaacctatatcggaggcgggtttggaaccgctgcattaaaagaacagatcgttgcagcgatgaaagagaaagattctgattttgaaaccggaatgaaggagcgaatgacgtcccggtcacctgatatcatcacatcaactgtagagaagatcggcgtgaccaattactctcttattaatgatgattctggtatctggctcatgatggtgcgggaatgaccgtctgtccatactgccctcatcactgtgacattgcagataggggcactggtatctgtggtatgtataccgcagtcaatgattacataattgagcggtttccggatcactggctgatggtaactccggtatcggtggagacgatcccctttgtccatgctttcccacaggcgaaagcgcttcaaatcagtactatcggatgtaatttgaaatgtccgggatgtgtatctgaagtactggtgagaaaaccggatgacatgggaaccggccttcggtaccagtcagcaaaagccattatcgatgaagcgaagaagaaagactgcaggggaattttattttgtctgaatgagccgaccgtatcccttccctctttcctgaaagttgcccacctggcaaaagaaaaagggatgtttgtcgggtgttcatcgaatgcctatttttcagagtataccttaaaccttcttattccggttctcgatatgataaatatcgggctcaaaggtaaagatgagaagaatatcagggcttgtggaattattgatgacaaagtggtcatccagaacatcaaaaagctcgtacaggcaggagtccatgttgaaattgctctgatgcatgcaaaggggcaggagaacgagcttattacccaggctaaagagattgtctctatttcagacaaaataccaattcaggtcatgcggtgtatggcatttggagatcttggccaggagtatgagccttcgattccggaatctgaactcctgtgtgatcagctgcgtgaatttgcttcccacgtatatctcttcaattcaccaggaactgcgtatatcaataccgtctgtccggattgtggagatgtattatcaacccgtgaaatgtacggacctatgggatgcagaccggtaacatttctggataccgggttatgttcatgcggataccaggttcctctctctggatcagcatcaccttcccggtatgaagaagaaggtatggatggcggataccgaccgacccgtgctcttgaatttatccagggaattgttacctgcctaggagttgatgatcccctttgtgctccccggctctggaaattataccttgcccatgggaagatcagttcaatacaccaacgaattcaaaagataacatcatattatgatattatccgagaagtagcagaaattgttgacaaaaaggatgaagggatagagttggtgtcggtcctggaagagatgaaaacccaggttactgataccgttaaagggatgactcatccccgtgtcctctacaccatgggatacccgatattctcactgaacgggggcagatttgagaatctgctcgtagatctggctggtggcgatcccgtgaaccggatgataaaacggtcaggaaaacctggagtaaacctttctcatgaagaatttttgtcgctcaatcctgactggatatgcatatcaggtcttttttctcttccgaaagaggagtgtattgcatattgcaaaaacaataatctcatggttcctgcaataatagagaataaggtcattgaagtaccgccatcgtgggactttggaagtccgcgatggattcttggtcttatgcttctggcgcagtcattccatcccgaaaattgtacctggaacatggatgaggttgctgaccagttttaccaacgattctatcatgttccctatcaatcggttcagccaacccggtcgtttatcaaggcgtctgcaaaaatttttggataatttttcccatttttctcgaaaacactgcagcggtatattctttgctacacaaaccaaccttctatgatcactgtgaatattatcaaggttcttcgaagagatgttttgagtgatgattacctgagtacggattatctgctatcaggtcaaattacactcgaagggctggatattctctcccagggggcctataccataaccggataccaatacctctctccatgctatcagattcaaaaacctgaaaatattcagatcactggtattttacagagttgtgttatccgggtcacctaccctgcatacaccgaaggatacatgaaagagtatctatctgctcttgtcacccttatttcagaccaacaacatgcgcactcatttgttcaaaccctatacgatgatataaaaatggttttcagatccaaatttcatcggagaagaactgaaaaatctgaaatagggaaacgctcgctcatttttatagaatgatcaacttaggtaattaaaaaagatcaacttctgccgcacaattaggtaaattattattacagagttaacataatgcattacgatcaagagatcatctttggagaaaattatgcatgtatcgttgactcgtatattctgtattcttgttacaggtcttttactaattcctggatggacaggtgctgagggtacaatctcaattgccgatattacaggcaaacaggtagaaattccggcggatgtgaccagagtggttaccgtcgatcccttttccagccagtttatctatgttatcggagcagatgacagactggtcggaacctgtatcggaccagcgaacagggatctggtgaataaaactcagcccaatcttggttcacttccgtctgccggatgtaaaacaaacgttaatcttgaagagttgatgagactaaacccagaactcgttatttcttcagtggattatacctcaatcaacaatgatatcgagagggtttccatccctcttgtacaaattgatctagaaaaggctgaggatctggtaaaaagttatgaaataatcggtaaaatttttggaaaagagaaagaagcccaggagtttatcgattattacaaccagaagatgaatactgttgaggagaccggaacaagcattcctgaagaccaaagaaagagtatttactttggtcagcggtcaccgctccagacacttggtgatgattattatgaagctgaaatagcccggattattggagcatcaaatgcagcaaagggcctttctggtggggataatacggtcaccatggaacgggtatacgaatgggacccaagtgctgttgtccttcttccctattgcccggcaagtgttgctgatattctggctgacccggcctgggagtcacttccagcagtcaaagagaagcaggtcttcagaatgccgaaatacctcatgagctgggaacttccggttccggagtcaattctcgggaccctctggcttcagagtgtcatctatccggaatcggtttcatttgatatcaaagatgaaataaagagcttttataaaaagttctatcggattgacctttctgatgaagatgtggagaacattttttcagacgacactcagatcattctgaataaaccttcaccataatttttttcctggtgaccagaatggaatgcgaaatgtgtggtcaccggtgtagtattcaggaaggaggatatggaagatgcaggatgtatacctgcaagaatggggagatatcagagcgtttccccgacctttacctggctctctggccaggtgctattgaaaccattccttttcttcactatactcctggtggacgttatctgcttctttctactatcgggtgtaatctctcctgtgaagggtgtgtatcatatgtcctggcaaagaaccaggatttattaaccgatgctctgattcatgcagagccgacagatgttctccggatggcgagagataacgcctgtatcggagcggttttttgcctgaatgagccgacagtctccctcgaaacggttgcccgtgtagcccgggaattgcatgcggctggattatccatggggtgtgcctcgaatggatgtatgtcggaaaaagcgctggatgttcttttagaccacatggattttatcaccatcggactgaaaggactctcagatcaggcataccagatcaacggggctccctgtaatgcagaacaggtctttcaaaccctgaaaacaatccattccagaaacatacatcttgaggttgctgctgtatgcaaaacatcagacatggaagagattgttactattgcgcagcggatactggagatatctgcagatattccccttcttgtcatgcggtttattccctttcatggagcggatactgcgcttgaaccctccgccattgcagctgaggacctgatctcagcctgcaggaaatatctgccatttgtctaccttttcaacacaccgtcaacccgttacctgaatacgtattgtccgaattgtaatgagttgcttgttgagcgttcatttaacggaccgatgggggcacgattttcaggcaggtatgcgcaggtatgtccttcctgtacttcttctatcccgatcagaggggagtggttttcacagttctatcaggaaccacggttcagaggaggatatagaactcctgttgcgcttgatatggtgtacagtatcctgaaagcagtgagtatctctgacgaagccactatgggaatggtgttaacaaaactcttatctaacgattacctggaacaattacagacaagacttcagactccaaagggatatatcgaatttttacaggtattacaacaatggtcggggagtctctcatttgagccggtcatcagatttctttcaggaagagtccagataatcgagagatattccaatgtaccgaataaaccgcgtgtcctttcagtcctttcccatccgctcctcccctcatatccggataagatggaaaatacactcatagcacttgcaggaggagatgttttgaattatgacctgggatatgatgaaaaatcatctgaacgattcacctgggatgcatttcaaaaattgaaacctgatatccttgttgtctcaggccccggtcatctgactcaccaggattttgttgatttatgcatgagagaagaccttactgctcctgcaatagaggaaaataatattttcatggtacctggaacacatttgagcgctggtccatcctggatcctgaccctggaatcaatcgcgaattatctccatccggacatttttgattttaacctggagtatgaaaaagcggttcttctcaaaacattacccggacttgagtgaatactgagaaaagaaagggctcacaatttttttaatatacctggctggcgaagttttgggaaaataactctgtaatcaggtactcccaaaacccatggatttgcagttctaaatcgggatgaaaactacaaattacggtgaaaatgtatcaggatgcagtgttttccacgttttcctgctcctttacaatttccataatttgaaccttgattttttgcttcaaaggtacatcaggtttttttgtcccatcccaggaatatcccataacgtcacagagaacgcgatttccaccgatcactctctcgattttcgttgcctctcccttattctggttgatctgaaattcttttactaccgcattccattcagatggatacagcgcaatttcatataattcatttactttaaccataagttaacctcgcgaatggctatactaggtaggttattacattatatatcagttctcatttttagattaattttcatgaaaaacagctcaataatttgaacacagaaaaattattgcctacagtctgcatagttgtaaaagaaagtggtggttagagaacatagcctgattattattgaggttacccggtagtcaaaataacatgatcggattgtaaatcataccggtcagagtatgcttgaatttctctatggtttattcttcattgtgctggaagtactaaccaccatatattaatctgaattgaaagttaatataattatttaatgcctgctcatgattcattatcctcataattttgtataatatccagagaaatttccaattttcgtgctttgagagtcatattcagaccttccattccatgaaattaatcatacaatcccattctccaaagctgaccagatcatcattgccttgtatatttccgactgtgtgtggtacattccatttatcgaagagtttctatagtattccctgattttttctttgttttcttcggtgagaacctgacgaagtgataaaaagtcaatagccttttgagccgcttcttccgggttctggtctcgaccttccgatttatgagtaatcttcacaatcggatgaaatccaagtgtatacagatacatgaacggatacagaaacccggacgcaaaaatgttatcccgggggatagtatccagaatccgggtatagatttcacagggaatttttgccggatccttccggataaagttgctgtaataacagaatctccttgaacaggccaccatccggtcaaaggtctctacatccttgattcccggagtaaatgatgcaataaccagatcaaacgagttacgaaaccccaatgtatcaatatctgcagtccaccaggaacattcaaccggagtgatcgaaagattatctcggaccgcaacctctttcagtctgtcaagcatgcctgatgaaatatcaagtgacgtgacatctgctcccgcttgtgccaggggaatagataaagttcccggaccacatccaatatcgagaattcgtgaaccaacagggttgaatcccgcttcctctaagagattaaagaaatcggaattctttttcctctgtctttcttcctctacatcttttccaaaactttctgcacgtttattccaactggctgcctgctcttcatccgacgtatagtacccttcatcaagggaggaactccagcagttaatccagttatgtatcgtttcattcagaaccatgagtacctcaggatgagaatgcatcagtacaggaaggttacctgtgctgttgtataaatgatttgattgtttccggattttgtcaattattttttattgatgagaattgttcacaaaaatatcttcagtactttgttcattcatcgcattttccttcatttttctccattactcatgattttttataccagatcgctcactgatgatcatccatagtgcaggatatcattcaataattgcgtatgggctattttatcactgtaactactattctctcctttttcggattgatgagatgctttttcaggttatgtactttaaattaattataggtgccattaaacaattttatgtatatgaatcaccaatactcataagttactatagattaaacctggagataacatgagaatcagtgcacgaaattcaatcaaagggactataaaatccattacgaaaggcccggttaattctgaagttgttcttgatattgggaatggcgttcttataacctcggtaattaccacccacgcagtagagaaactcggactgaaagaggggaaaatggcatgggcattggtcaaatcttcagaagtaatgattgccgttgattaacgaaagaaggatgttagaaagagctgaaaagtaaaataaccggcattcgtaggaaattcaccttttccaatgaaactggtgaacaattcaatttttttgagatttatgagtgactttgagacattactcgaaaaagcaaaagcattccatggtgatgcctgtccggggatcctgatgggcacccggatgaccatggccggtatgcgtgagctgggtatgaaccctatggaaaagaaccgtgatcttatcgtctatgtggagattgaccggtgtgcaactgatgcaattcaggctattactggtgtgacacttggacaccgaacgctgaaattccgcgattatggtaaatttgcagcaacctttgtggatagcagatcaggaaaggcagtgcgagtcacagcaatccccaaaaaaggagaaaaggagcaagattttcgggctattgcacagaacctggctgtcgttccggaatcagaactctttactatccagaaagtcacggtaactattccggatgaagatctgccaggacaaccaacccataaggagttttgttcaacatgcggagaacagatccttgataacagggaaatgaacaccaatggtattatccaatgtaaaaactgtgcattcgggtcatattacattgctattgaatgaatattcaatttaaaacgggcagaaaggaataaaaatccatgaacccgacaacagaaaaacaagatgccatcctttccgatacgattgatatcctgaaaacgaggatacctgttcctttttcagagatacgacttgattcggttgttgtgggagtattttttaccggtgttaaactcagctccggatatggagggatctgtttcaccccggttgacctcattcctgaagcagtctgttgttcaaccgctgcaagtgcaatgccatattgtggaaagatgcagggagtatcggttgaggatatgctgacccacatgtcatcaccggcacccctggtcagagcagttatcattagcgttgtgaatgccctgtctgcatggttttttgacatctgtcctgaaggtacctatgcaattgaacatgacaaggatgcatttgacctgcttgatactattgatccggcgactcctgtagtggttgtcggggcactatggccggttattcaccggttaaagctcaggggggcccaataccggttatttgaactgaataagggcgctctccgggaagaggaactaccattttttgtaccgccagaggaacagaatgtagtgttgtcacgagcagggtgtgtggtattgaccggagcaacccttgtaaccggaacactggaaaacctccttgcacgaatccctcagggtattccggttatcatcggagggccaaccgtgagtatgattcctgatgccttcttctccaggggagttactgccatcggtggagatatcgtaacgagaccagatgaaatcctctctaccgtcatgcagggaggttccggataccacttctttgggaaagcagcggacaagatcctgatccataacgtatgatgagttccatggaataacgaatgaacacgatgagtcaggatcaaaagtacgagccgcttatcatttacccgcagtattatgatcgtatatgccaggcagagagatatgcatcatctcttctaccctttattccccggggtctgccggtatttcagtcgcatgggctctgtcattctgaaacacttatcaggtatattcaccaggtgcttggaacattgccaatttctcttaaccatgaggagatatttctcctattcctggctgcatggtttcatgatatcggttatcttcatcccctctccatccatgaccggagcaggcatgcagagttctcatctctgataatcaggactgatccttttctctcagaactgctcacaggaagagaacgtaatcatctggcattcctgattgaatgtcatgacagcagggtggattttacttcgagaaggatcacatcccctctccggatgcatctcatcacagctctcttccgtctgattgacgctcttgatcttgggactgaccggtgtccgccagaagtcttctccctgattgaggatgggcttgatgaacacagcagacgacactggaaagcccatcagaacgttcaatcatgctttttcaggtatccggcactgaccattatggtgtatgttccagaagatccctttttcagattgagaattgttccccacctggaagatgattgttcatcctgcagcccggtattcttaaaaagcggactcgaaccctgttacctggcaatagagaccagtgatgggaaaatgccggagatctcaccatggagaacagaaaagaaaatatttctcgccacagtctcttcccatgggcaatgaccacaatcagggataacaatacttgtaaaccgtggaagaatacgggttaatggttcaattaccccctgaaccggatggggatcataatcaccatgaatcgcggtcaccgggcaggagatctgctgaaagcacgaaagaagctccccagtctgtcgcatttttgccgcttcagcccatacctgtgagaatatttctggatcacaggagaaggcaccgatttcatctttgttttcctgaataggacaaaatgaatcaactttttgaatcaaacttccgaaggttttcaataaccgatccctatccggacatgctgagtcctgtatctgcaccatgagttcgtgcattgtttcctgttcgtccggagtgagacgctccatccggttcttccatactacagcatattgttcttctaatggacctgcagagatgagaatgagatggtacacaagttcgggatacctgcctgccaccattcctgaaagccaggcaccccatgaataaccaaccaggatgaccgggatttctgcagatgtacggagggtctttgcgagttcctcgatctgatcatggattgtcagtccggtctggaatggttcgataatcgggaaataatctgccagatatcgggcgaccggacccatttctcccggtgcacctggacctccgtgtatgagagcgatcctctttggatctggaccataggatctgtatttcatttcctgtccaaatctctggttcatgtaaaattttagaatatttgaatcctgatatccttcttaagatttttcatctattatccgccctcgttcaatctcaagaatctttttggcaattccggaaatctcagtatcatgatgagatacaagaagacagggaattttccattcctgaacataccggctgatacattccttaactacctccctggtttcccggtcaaggccggtgaatggttcatccatcaggagcagggccggacgggtaacaaaggcacgggccagggccacccgctgtttttcaccaccagaaaggtctcgggcaggcagatcccccatatgagagatattcaggatattcagccattttttcacatccacctccttctcatcccggccatgagaaagcgagtaaagcccatactccacgtttttttttacggtcatatggggaaagaccattggattttgtagaatatacccgattttcctcttctggataggaatttccttctgggaggagacatcacataccaccatatcaccaatcctgatatagccctcatcaggattgagcaggcctgcaatcattcgcagaatcgtgctctttcctgatccattgtctccttttaggacggttatctccccttccaatgcagtaagaaagacatcaagctcaaaatcacgaagttgtcgtttcactcggcattcaagcatttttatcttctcctgagaggattcggaccaataacattacaaaaagggaaataccaaccagaagtagtgatatcgtgacggccgcgttcatatccttctgcatggcagtatatatcgcaagaggcatagtctgtgtcactcccggaaggtttcccgcaaacatgatggttgccccaaattcacctagagcacgggcaaatgccatgattgccccggatatcaagccaaaactacagagaggaagagttatggtgcaaaagacccgaaacggtccggctcccagggttcgtgcaacatcttcatatcctttttcaagttgagtaaaaagtgatctcgcctgccggatgtagagaggggatgcaacaaagaactgggacataaccacagcaagggtggtgaacgggatcgtaaaactgaacacagccagatattttccgagaagacccatcctaccccaaagcaggagaagggctagaccagcaacggcaggaggcagaaccagcggaagatcgatgaacgtatcaacgatctttttacccggatagggatatctgctctggataaatgccacgggtgttccgattatgacaagcacgatggtggtaataaccgtagtgaagagggagagtgtgagtgactggatgacaaagggttcagtcagcgtaagaaggatctcttcaggggtggttttgaggaagagggcgagcaggggaagggcaagatagagaaaaaggaggataagtcctatgaatgcagcaagatagaaaaaaccgggtcgatttttcattctctgcaggtgaaacatcattaaaaattagggagctggagaaaatccataggacgctaaaatcttttgtccttcctcaccgagcatgaagttctcaaatgcttctgctccggctctgttcggggcgaggttcatggttgcaatgctgtagtactggagttcattgaaattttccggaatcgtgaccatgttcaaatcctcttccgaggctttgtatgaggattcatagataaatcctgcgtcaacttcaccaagttttaccttctcaacgacaccaggctcagtggtctcatacgtggcagtgtttgcaaagactgcatctttccattcagatccatatgccgagtcatttgcaatcttgtcaataaccttgcgggtattgattccaacaggaacttcttcggtgcccatagcaatcagcataccaggctttgcaaggtctgcaagagtggtaatctctgcaggattgtctttcggagttacgatggttatccagttagtacaaagatcggtaactgtatcattgacaaagtagccactttgggtaagctccttggtgtattttgcacttgcagagatgaaaacgtcagggagagccccattctcaacctgggttttgagggcctgggttccatcaaggttaaaggtaaccgttgttcccgggtttgcttcttcaaataccggtttgatctcctctgatgctccggtcagggatgcagccacaaacaccgttacgtctccgatctcatctgcagaaacagctgtagagagaaggagaagacaaaaaactccgaggattgcaagaatccgggagaacttgtaaattctttccattattataaattgagcttaatgctattttaaaggaacgatataagtaatcaattgtaattaactctattcggtgtgaacactatctcatatatacaattgataagtcacactcctcaaatttctaaaactaataaattcaggaacgagatagcatgtattaccgaaatgggtcattatgaatctatctgtatgaatctttgggtcggagggtgataaacaaatcctcgattacctggtattatgtaaaaaagagactgatattataagataacttcaatcgaattttagaaaagtattgtgctaaggaaaagtttggtagttagattaatccacagcaatcattacttcactagatttgacgacagcatatgcctctttaccttctttgaggccaagattctcagttgcatgtgcagtaatgactgaagtaatctgaaccccatttccgatatccagaacaatctctgccattatcggacccttggtaatcgattttatggttccttttatacaatttcttgcactaattttcatttttttcactcctttaccaaccatatcatcatggcgtacgtttaatatgattcaataattgataactccttttataagttgttcaatttaacttattaaaatactggagaataggattgattctctaagaaatggctttttttcatcaattgggacctgatggtcaatatttctgcaaccggacaataccgatgactggtttttccagatcatgatcagttaattcgtaaaatccatcaactttacatcctacctgaaaacacagattaaaaatctcctgattcctatatcgatatggattatctggaatgaaaattgtgagaaggagtctataagatcatggtcaattcaatgtctgactggaaaccaccacgatttatcatcaccggtgaacaaggggaaggaaagacaacacttctcctgaagattcttgcagaactcacaagtcaaggaatcagaatgcatggtatcgcggctccgggatatttcaacgaaggtatcagatcaggttttgatgttctgaatgtacattccgggagaactgtagaactctgctcggcaattccaacggtaaactctatacaatatggcaggtattactttcggtcagaaggccttgcctttgggaaggagatattaagtcaggtaccactcccaggtcaggtggatctccttgtcattgatgaggttggaaggttcgaaattgcggggaaggtatggggagagagtattgatcatatcatgcaagcaccccgcacaccgatgatctggacggtcaggagatcctttgttgatgcggtcacaaagcgatggccggtccagagacagagaatcattgaagtcgggtctgaaaactacgatgatttcattcatgatgtgataaatgagatccggcaatcggtctgatacatttcaccggtgaggtatacttttgtctgctgaccagtctacacgcatatgttcagggactcctcctctcataacaaggaatacctcggaaattaccgataaagcaatctcctgggggaggttttttccgatgcgaagaccgatggggcagtacacacggtcatcgatgattccaccacggccctgtatgtttcgaatcaacacttcagcctttttcacacttcctatcattccaatatacggcagttctttgattttgagaagttgttcaaggacggtttcatcatgttcatggccataggtcatgattacacaataacttgtccccgtaagatgaatatgtgaaaatatatcggtaaaaggttgacatatgagagatcttgctccaggaaaccgctctggatctgcaaactccctccggtcatcatatacccggtatggaacattcagaacttcacataatttcccaagggcaagcccgacatgaccaccaccaaaaattaccagttctgattccggaatgagaggctctataaaaacggtgagagagcctccacaaactccgagttcagcatcttcgtcggatgtattccaatcctccccatctcctttcgagacaaatttccgggtaatgcaggccccggtcttcattgcctccctggcaaggtgaatacattgtaattctactcctccgccccccaccgatcctgcagtttcaccattctggttgatgaccatattggatccggttttccggggagtagaccctgcagaatcaataattgttatcaaggcacaggaaatcccctcattataccatcttgttatgttgtttagccacatcctattcaccagtttcgttgatactgtcacatagtgagagtaacttcattttaaaggcagaaatgtcctttaccatgttcacccgttcaagtgctccaggaggggaatacgcaatactgcctcccccaagttctgcataacgggccatgagttccatgttctgtacaagagtaaccccgataagatccagtccacatgcaaagagtgccggacttggagggacagtcggtcccatcatgatcctgatcttcgcatgtggtgtccgccgaatcactgctgcgagggtctcattcacaacagtcagaccgctcatcagtactacctgtgccctgctcagtacttcatcggcatcattccaatggatatcacctggccggggaaagagttcaacaatatctaccggccatcccatttcgcgccattctgctccctccttgaaatatcctacaaagcaggtgggaacgcgagctgctgcatcccgcaccatatcaatggcgttcccaggtattatcggacaaggatccggaaggagcgactttaaacatgccattcctactgctcgccggagcgtctccgtactggagagaagttctaacgctgactcttttccgggtttttgtagccagtctcccatccacgagtccatacctgcaggatcggtcaggccaggcattccacgaaagattgtggataatgaccatttcccggctttaaccagaacccagtttgtataaatgcggatgtcttcgattaccgggtccggatctgcggccctggcaatctcccggatgagctgatcatagtgaggaatttccattttaatactgcttagttttacttcgatgtaaattaatttgagtattgaaccaacagagagattcgcaaaagatctgttcattcatgaaaaggggtatatccaaatgatccattcagcgaatctctgtcaaatatcaggaatgtcgataattatccatcatccctcgggaggattgtatatgcaccggagaattagtcattattgccagtccaatcgaaccatggaagcatatttcaagaaatgatgacgatttcaagaagagtgagcagatataccctgaaggatggatgattcggacacaggacattccgattctggcatcgctggggaagatccatattaaggtcaggaaaaaaccgctcataggcattatctccagcggaaaagaactggtcccggcagaaacaatactaaaaccaggggaggtcagagaggtaaattctcatctcgtcgcagccttttgcagatgacagggagcagtttgaatgaaatatggtattcttcgtgataatcccaaggaactagttagtcttttgaaagacgcatcagacgaatgtgatgccatcatagtacgtggtggaagtaaccgggatcagaatgatatcaccgctcaggtcatccgttccctaggaaaagtgtaccgagaagggatctcttttgccccggataaacggacaacaattggaaagatcaggacagtcctggtaattgggctgcccggtcaccttcctgccacattcatgatgttaacgctcgtgattgttcaccagattcaggtcatgaaatgagcactatgtcagcggttttatagaaaagaagagtgggtggatttcattggtcatttacattccaccagatctttgcccggtgcgtcatctcacgaaggacgacctttccattctcccgaatgagttttttacccaggtagtcgcgaaggatatcttcctgttccgaagttgtgaggtgtagcccctctttttgatcagcgactgcttcctcaatacttgaatatcggtgaatactctcctctttgctgatatcaatattggcataaattcccatttggtgaagaagattgtagatgatgttaggcttattccctgaaggccggggaatcccatataatttctcccagatttctccataatttctctgccagggagagagcatatctgcaaaccagaaaatatagacatatcgggatgaggcagccaccattttcaggattccttcccggagatccggaaaacccagcgagtatgacgcaacaacaacatcatatggtggatttaaatcttgtttgacgtccacctcttcccattttttcgggacaatatccacgttggtaatagctgcaagagcaatattttcacgaagacaggaaagcatcccctctgaaggctcaacagctgtgacatgtgcaacaatggatgcaagagggataaccagagttccaggtccggcaccgacatcaagaatccgataactctcatctatgtccattgcagagacccgtgccctggatcctgcccagttatcttctttcatgacatcgttaaaccgtttgcatcgatcaggatctgaccatcgtctcccacaactgataaaacccttcttttttccctcctcaccttcaggtttcttccaggcctcattccaatcaattgtattaacatcaatcatgagttaatattttcatgcgaattataaaaaatattcagtttttttctggaaaaaaataatgtgatctcattctcatcgtagaaccctttacaaagatgccatgaaacgagcaccattttaccagaatggggagatatttaagtttcatataggttgttaattttattaattgaactaggtgcttcaaataacaatctttttaacacttgtaaacatatcattcttaacaagcaggcaatcttgtcatgtaaggtttactatgaattcatcagagcatgtaactcttaataccctatctcttccaccccatgacatcaacatccctccggcacaatataaccttcaggctattaaagcatccttgcacattacaacacctatcaggattttattattcctccttcctttcggggtgatcttctggtcattatttatcgggagatacgaagtagaaccacttactgtagtaaaaatgcttatttctcaggtcattcctatcgagcaaacatggaccaatgcagatgaaaccatcctctttcaggttcgtctccctcgtgttattgcagcagtcattgtcggggcagctctctccatggcaggagcaacataccagggattgtttaaaaatcctctcgtttctccagatattctcggtgtctcttccggggcaggatttggagcagcacttgcaattctcttctcaaccgcagcatggatgattcaggtttcagcttttattggaggaatactcgcagttttagcatcgtattttctttcacggttatataaaaacgggcaaatacttgtgctggttctttcaggtgttattgtatcagcattttttggagcactactttcaatcaccaaatatgttgcagatccgtacgagaaacttccaaccatcatattctggctcatgggaagtctttcatcagtcagatactatgatatccttacaatactcccggcgatcatatttggaggaagtgttcttatcctcatcaggtggagaattaacctcctttcattaagccaggatgaagcaaaaacccttggcattgatataaagaaaatcacccgtgtcatcatcatctgtgcaacactattaaccgctgcatcggtatgcattagtggtatcatcggatgggtgggccttgttgttcctcatcttggaagaatgataaccggtccggactataaaaaactcctgccacttacaattgtaatgggtgcatcataccttctcatcatggatgacttgtccagaacaatcattgcaacggagatccctcttggaattctgaccgcattacttggtgctcccttcttcgcgtacttgctctggcggaggaagaccggatgggtataacgtactcagctcatgatcttcagttcagctgggatggaaaacgggatgtattcagggacatctccttctctcttcaatctggtgagattttttgcattattggtccgaatggaaccggtaaatccactcttatgaaatgcatgattgatattctggaatatcagaatggagtagccatgattgatgggactgatatcagaaaaattgaccggaaaactcttgcaaaaaaaatcgcatatgttccccagggctatcaggttgcatttccctattcagttcttgaatatgttctgatgggtcgggccccatatatttctgccttttcttctccggatgagaatgatctgaatattgctcttcgtgcaatccaggaagcaggaataatgcatctcatgcataaatcagtaaatgaagtcagtggtggagagcatcagatggcgttaattgcccgggcgctagctcaggaacctgaactcttactccttgatgaaccaacatcacatcttgattttggaaaccagatgcaggttctctatcttgttgagcgactcaaagaaaagggaattaccattgtcatgacatcacattttccagaccatgcatttatggtatcggatcttgtcgggatcatgaaaaacggatcatttgtcactatcggacctgctgaaaaggtaatcaccaatatgaccttaaaagagacctatatggttgatattcacgttgaattcgttgaaattgccggaagaaaagtatgtattcccataaagaacattccaggatgtaaatgcccagtacacccaatatcatccttccagcagaattaatcgaccatcctggaaataatgttcatgagaataatatccgctgatatcccgtatatatcgtcatattgggcggcctgacaaacccggccagagtcatgtttactatctttgcaaactctattcctccggcgaatgccgcattattcgatatcatcactggaattcctgcacggtatgcttttgcaaccatatcaaccgggagtcttcctgaacagaccaggtaacaccgggagagatccgccccttttaaaatagccaatccgaccgctttgtccaccgttgtgtgcctgcccatatcttcaactccactgacaacggttccctcctcatcgataataaggctgcaatgcataccgccggtccgtttccagataactgagtattcattgactttatccatggaatccaggatggtctttgcactcagagtaaaaccgtcaggaagagggttttgcatccctccggggagcagatcacgacaagatcccccagaactgtttttagagaatttaccggatggcacagaaccagtcccggttctcacggagatattcggaagactgattgtaatctcctgaatctcttcactggaacagatataaccttcacaaataagatatccaatggcaaaggcttcaaggtcaagcggggttatcgagagatcaccaatgatgccgccattcagagtgaagattatccttgactcagtacatacctcgacggtagtttcccaaatttcagttccatgagctttgattacctgatattcttttgttattttttgggtcgcgtcattttgtgtcatttctgtcacccgggtaggaaaagagagggaaagaaaatttcaggcctctgtgaaatactggaactaataggaaaaaaaggttcggattattcatccgtaaagatattggtgtatattgaatcggtgccagttgcatcgagacgtgcacgttctgccttttcctcaacaaaggcatgaattggaggcgtcatatcctggcccgggatatggccaaacatcttctctatctcaacctgttgagagtgcatgaaaagggcattcgggatttccattggacaaagttcctcacactgaccacaattgatacaggagtctgaaacatgtgcaaaccttatcaggtggaacatgaagctggttggcagaacaccgggagcaatgtaccagggcttcttggtagaacactcgatacaatagcagattggacatgcttcaacacaggcataacatttgatgcattttgaagactccgacatcatgagtttcagacggtccttgcctttacccatgccctcaaagtcacggtgtctccactcatcaccaaggttgaacattgccttctcgactttcgctcggatatcaataccctttggatcagcaggagagatctcaagagcaccctttgactgagcactgtttacaaggtttgcacccttctctgaacagatctcaaggaatgttgccttacctgccttatctccgatgactccccaatttcctgctgcaatatctgcctgacgggggattttcatcttacagcgtcggcagttggaacgccgaccatatccttcctcttcaagctcatcgatctttatgcccttgtgtccaccttcatactctatgatgaactgacccttgtcaatctcttccttatgaaccgtgtcagggtcaacaccaaacttgtttgaaatcatctttcgtgctgtaacaggacttacggaacctccacagttgacaccgatcatgatgatgttatcaaggtttatctggttccgctttgccagctcatagaatgccatagcatcacagcccttacaggtgactgcgagcttcatatcctttgcaccgttcagatatttcttgatcagtttagggataaggagtgtgccacaatgcaatgacccggcggtctggatgatgtcttcaggattggtaatgacggtcggtactgcatcatacagatctttgcccttcttgatggcaactacagcatcgaccattttagtttcaagggcatgttttaaaagtgctgtgactgctccaccacactctcctttcttctggatttctgcgtcctttgcccaagcatagagcatatcacctttagctgccattttagttccctccaaccttttcaattgatatggcacaatgcttgagctccggcatcttggacattggatcaagaacggtattggtcaggttgttgacaccatcagcaaaatgcatggtcatgtacacaacacctggagcgacttcatcggtgacacgtgcgagtgttgtggtctctccacggcggcttttcagcttgatgtactcattgttcttaataccaagacgacgtgcatcctcaatattgatctgggcatatgattcaggaacctcgcggtgcaggtctgcagcacgatccgtctgggttctggaatgatagtggaagataagccgtccggtcatgagggtgaacggatactcagcgtcagcaacttctgctggcggccggtaatcaattccaaagagattacccttgccgtctgcagtagcaaacttttcccgatgcagaattggggttcccgggtgctcctctgttggacatggccagcagatcccttcaggcctctcaagtttttcgtaggttgctccgaacatggacggagttaccgcccgcatgtcatcccatacatcctttgcagtcggaagttcaaaacctttaaagcccatctttgcagcgagttcagagatgatgtgaatatcttcttttgcctgacctggtggattgactgcttttctgacccggttaatacggcgttctccactggtgaaggttccgtctttctctgcaaaacaggctcctggaagtatgacatctgcatattgacaggtttccgtgaaaaatatatcttgtacaacgaggaagtcaagcttttccaactgtgctttaacatggttagaacttggataggttacaacggggttcagaccgaggatatacattcccttgatctcatcgccgcactggttgatctgttctgtgagggttgctccgtaccagtccgggagattagtcacactccatgccttctccatcttcgcacggttttctgcaacttcacatttctggtaaccagagtagacattcgggtatgcacccatgtcacatgctccctgcacattgttctgaccacgaagtgggttgactcctactccctcacgaccaacgtttccagtcagaagagcaagattacccatggatctaacattatcagtacctgtggtaagttcagtgattccaagacagtagatgataactgcattctttgcctttgcatatctgaatgctatatcttttacaacatcaaggggaaccccatggattgcttctgcatcggcgtagttctcaaccgtcttcttgagatcttcaaacccgttgacacgatcttgaatgaattttttatcttcaaggccctctttgatgatccagtacatcatagagtttgcaagggcgatatgggttgatggattaaaccgcacatatgtgtcggccaaacgggcagtcatcgtgtaccgtgggtcaacggcaataatctgtatgcctttcttcttcgcctgtgcaatccgacgacctgccaggggatgtgcttcgactgcatttgatccccagatgagaattaaatcggcgttcagtgcatcttcaaaaccatttgttgctgcaccagaaccaaaggagagtgaaagacctgcaacagatggtccgtgacagatccgggcacaattgtcaacgttgtttgtcttgaatccaacacgtgcgaacttctggaatatatagcaatcttcattgacggttctacaggaggtctggaatccaagtccttttgggccatgtttgtcgtagatgaccttaaggttctttgcaacgagatctagtgcctcatcccaggatgcctcaataaactttccgtcctttttaatcaagggagtggtcagacggtcagggctgtgtatgtgttcccagcaggtaactccctttggacaaagttttccttcattgatgggagatctctggtttggctcaacaccaacgaccttaccattactaacaaccaggtttaatgtacaaccaacaccacagtagggacaagtggttgccacatatttcattatttctgaattttcactcatatttcacccgagtttgactggtgaaagataccgtaattacaggtacgaagccttcgctcttcaaatcattcttgcgttttgtaaccaggcacacaggaatggacaacccgaatatgtccatgggtgtaatcgcacaccccctgatcacaatgcagagaagtattactccacatactcatataaagatggcgaattaatccggaattttggtttttagtggtgggaactattcagggaatgatttattacccaaatgagatggtgaaaaaaagagtataaaaaaatgagaaaggttagtttttgtatggagcagcgccgagtttcggaacgtaggcattatccccttcaaccctgatggcatgtgagataagagccagggggatctcaaccggacagagttcttcgcattgaccacaatttacacaactgtcagagatggatgcaaaccggcgaagatggaacattgggtctgatgggatataccctggtctgaccatatatgattcaggccttcccacgaatggtgtggagatacaaaccggacacttttcaatacaggagtagcacttgatacaccgtgatgtctcctttttaatgaagtcccagagattgtcacgaagtgcagtaaactccttcttacgccatttctcaccaagtttaagcatggctccctctgtcttgcctctgatctcgattccctttggttcagcagcacaggtatccagtttcttagctgatactgcctttgaaacgatatcagcacctttgtcactacaaatctcaataaaggttgccttcccagccttatctccgatcactccccaatttccacaggcaaggtctgcctgacgggggattttgtacttacatcgccgacagttggaacgacgtccataaccctcttcttcaagttcatcgattttgatgcccttgtgtccgccttcatactcgatgatgaactgacccttatcgatctcttctttagtaaccttgtctggatcaacaccaaacttttccttgatcatcttccgggcctgaattggatttacagaacctccacagtttacaccgatggtaaggacattgttcatgttgatctcgttcctcttacctagttcaatcatgctcatgaggtcgcaacctttgactacgacacccactttcatgttctttgctccgtccaggtatttctggataaaggtggacatgagcagggtaccacagtgtaatgacccagctgtctggtcaagatcctttgcatcggttatggcaacgggaacggcatcatacagatcaaatcccttctttactgcgacaacaacatcaacgatcttgttttctagtgcatattttaaaagggtcgttactgcaccaccacactctgcctttttagcaataccactgtcagttgtccaggcataaatcatgtcgcctgttgctgccatattagttcccccctatcttttcaactttcacagcacagtgcttgagttccggcatcttggacatcggatcaagaacagtgttcgtcaggttgttgacaccttcattaaagtgcatggtcatgtacaggacaccaggtccgatctcatcggttacatgggcgatggtctcggtttttccacgtctgctggtgatcaggatcttctcatgctgtccgataccgaggcgtcttgcatcttcgttgttgatctggacatatgatgcaggcacttcgtaatgaagagcggcactcctgtcggtctgtgtcctggagtggtaatggaatatgagccggcctgtcatcatggtgaacggatactcagcatctgcaacctctgctggtgggcgatattcaataccaaagaggttaccctttccatctgcacaagcgaatttttcacaatggaggatcggggttccacagtgctcgagagttggacaaggccagacaatagactcaggtttttcaagtttttcgtatgttgcaccaaacatgcttggggtacagttccgcatatcatcccagacgtcttttgcagtcgggagatcaaaaccctttagacccatcttctttgcaagttctgatataatccagatatcttcttttgctttgcctggtgggttggttgcttttctgacacggttaatacggcgctcaccgctggtgaaagtaccatccttctcggcgaaacaagcccctggtaggataacatctgcatattgacaggtttctgtaaagaaaatatcctggacaacgagaaagtcgagtttttcaagttgtcttttcacgtggttggaatcaggataagtgacaaccggatttaaaccaaggatatacatcgtcttgatctcatccccacagatgttaatctgctcagtaagggtctgtccataccagtccggaagacctgtcacgccccatgccttctccatttttgcacggttttcagcaatttcgcacttctgatatccagaatacacatttggatatgcacccatatcacaagcaccctgtacattgttctgcccacgaaggggatttacaccagttccaggacggccgacatttccggtgagcagggcaaggttacccatagacctgacattgtcagtaccggtggtcagttcggtgactccaagacagtaaatgataactgcactctttgctgatgcatacttatatgccagttcttttacggtttcaagtgggacgccatggatgtcttcagcatctgcatatttttcaaccgtcgccttgagttcttcaaacccgttcacacgttcttcgatgaatttcttgtcatgtttgtctgctttgatgatccagtacatcatcgagtttgccagagcaatgtgtgttgacggattaaactgaatccacttatctgcaatcttggctgtggttgagagacgggggtcaactgcatagatagggatccctttcaattttgcttggacaagacgccgcccggcaagggggtgtgcttcaagagcattcgatccccatacaaggataaaatcagaatttagagcatcttcaaagccattcgttgctgcaccagatccaaatgatagggaaaggcctgctactgatggcccatggcagatacgtgcacagttatcaacattgtttgttttaaaaccgacacgggcgaatttttgaaagatataacagtcttcatttactgttctgcaggatgtctgaaatccaaatgctttaggtccgtatttgtcggatgtttctttcaatttctttgcgacaaggtcaagagcttcatcccacgacgcctcgacaaatttcccatctttttttatgagaggtgtcgttagccggtcagggctgtggatatgttcccagcatgtcagaccctttggacagagtttcccgtcattaatagggcttcgcttatatggttctacgccgacgaccttttcattcttaacaacaaggttcagagtacacccgacaccacaataggggcaggtggtttgtacatacttaactagattgctttcgctcattctttcacccgagttctcagggtaaaacaagccatgaggactggtttccttccagtccctgagaagaacgttcaataccgggaaaccacactaaccctgtatcgatcagaaaatctcatccaatttggctgttttaaccggtttggcgaattaattgtgctctcatccggtgatgagatgacactggcaattctcacgcaaagataatcagtatcatatcatgtatgttctgattatctcattttcgaaggttcgaatcatggtaacgtgattcatatactgtgaggcataacgaatctgcctgaatacctgtcccttcaggtatgaatgcatactgattcatgcgtgtacacagtatagttcatctgttcctgatatcaaagcataaatcttacgaattgaaattttgaattctacctaagaaaacggggcatatatttcgcgatattctgaaaattcgccgattttcatttttatgataattgtatcataagattacttattttgtggcatttctgtcacataaatgaaattcaattaatttctaaatttcttaacggagtatagtaatcagagaacctgtcttttcaggcgcgattgaaataagaccaggtacaaatgaatgaaaaggatatcatatgatattatggaccctgaaagatggaaaggtgttggtgaccatctggtctattgtgtgtggttttaccctttcccggttaaccctgagagatcccgtatctgacaaggtccatcctcattctacctcatcatatatgcggtattcatgagtactagttcgttgttttttgtcagatataatattctgatatttggcgtcctgatacctaaatttaatatataaagagagatcgaacgaattttatcatcgaatttagtataattgttacattctgtgtttttttatatcccaggtaattcccaatatcagtccgctgaatcttgagagattatcgaaaaagtctggatatacgttcagggatcagatcattttcttcaacctgatctctacttctgttcctttccccaggccctcacttcgaatatatatttctcccccaatagccatgattaatcgttttgtcacagaaaggcccagacctgatgatgaacggtcatgacgggagggatcggctttaaaaaaaggttcaaaaatcctggataaatccttttctgtcagacccactccattatcctgaacacaaatcctgaccatctgtccaaggtcttcggtatatattctgatggtgccccctgcatatgagtatttcagggcatttgtaatgacattatcaaagatggatattacatggggtaaagaagagttaatgcaaatcgtatcagggatatctgtcagaatggaaatatcttttttatttgcggcgatagaatggacattgagcaaattatcgattaattttttgagatttatttcggattcatcttcaacccggtatggtgatcctaggtcattgaaatgaagaagtgtctgtataattgatgcaatccgagtggcatttttctctagaatttgaattatttcagttcttttctgtgtatcatcctcgttttcaagtaaggggagtagagcgataagaggagtaaggggagttctcagatcatgagcgatagcggtaatgaggagatttttcatctccaataaatttgcgatttccgcagtccgttcttcgactagtctttcaaggacctcgttctgattgatactcttatttagctggcagatcaatgatttttgttcggtaatatccaatccaataaatccgataaatgtcctgtcatcttcagagatggggaagaaaactgcagataaaattctctctccctctttgagatctatccggcactcctgaaccgagggctgtcctttttctataacttcccgaagaatctttgaacattctgtctcccaatctgatttaaataactcatgaattctccttccatttttttctttatccggattgccattcttttttgagaatgatcggttcgaaaagacgatgaacccatgttcatcaagaagtgctgcaaatattggagaagaattcgaaatattcttgaataaccgcgtcatcagagataatccccgttcagttttctttcggttggtaatatctcgagcggtaatcagaataccctgaatcgccggattatcaatgcaatttactcctaccccttccaggagaacatatgaaccatcacgttttagtgttctgaattctgcagtttcgatcacggaaatattgtttataagtctgtccaacctggattttacaaccgggaaatcatcgggatggacaaccttgcctgcaggcccaatgacctcttctgtaagaaaacccgttaaagaagaatgattcggacttatataggtcacttcatacttgggggagacgatcataaagatgtctgaagattgggtgacaatcatcctgaataactcctccctgtttttcagatccccaattaaagacttatattcggtaatatcctgcattgatccaacgattcctgcaatattaccagcatgatcataaaagatactttttgagacgatgatatgatgagtttttccagatttatcggtgagttttgaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggatcgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatcaattagtctattttggttgatagcttaaggggtagagatcgatcatttgtgatcctgcatgatattgatcattggtgcaacaccctcttttatctgatatttttgaaccggattgttatgaattaactcctgatcgtgggttattgtctcaagcgatatattgtggtcaggccatacctcatcaattgtttttcccaccaggtcttcttttgatatccccatatatgtacaatatgcctgattgcaacccataaatctgaagttcttatccttccaaaaaaccgggagagggagtgcatcaagaagggcgtccgtgaatttttgttgagataataatcgtttaagaaagatatcccgctcttcttccaactgtttcttttgagtgatatcacggaatgtgacatatattgcatctgccacatccatttgtatctttctcccctgggtctcgatccagatttcacggtttttgccagtgatgagtttatactgtgagatgtatgaatcatttcctgatcttacctgttctatatcatgcaaaaccaggtcatagaaatcaggatggacatatgtcatcacgttttttcttgcaagcactgtatccgcagattcttcttcaaccatccggacaccggcagggttgatataaaatattgttccgtcaaatccaatgatgagaatagcatcccgtgaatactcggccagaacccgatattttctttcattctcctctatctttcgtgcagattttttcacttctgttatatcacgaatcgattcaatatatccagtaatgttcccctcattatcatacagaggacaggcctttataaatagtgcgatcaaatccccttgtgtattgacatactccgcttctgcctgaattacatttcctgaacgtgaaatgttggtataatacctggataagacctcattgctctcattgagaagatcaatcagaaccggatgacgatgcccataaagtgtagcagcatactcatagtttcctttcccaagcatttgtgatgaggagtaaccggtcatcttctcaattgcccggttccacgcaatgatcgtgccagaccgatctatggcaaaggttgcatcaggaagaaaatcaataatatctgcaagttgtttttgtgagtcctttagtgatttttctgccctttttctcgcgaccgcctgtttgattttatgtgataattcagcaaactgggattttggttcaccccctttttgcagataaaaatctgccccgttattaattgcttcaatgacaacctcttcccgacccctcccggtaaagagtataaatggtatatcatttccctgttctcttattgctttgagaaattcaatcccatcaataacgggcatctggtagtcagagattattgcatcatatttttgcaaaaagccgggaagaagaacttctccagctgattgaacaatatcgacggaaaattcccccattcgctcaaggaatcgcttaccaagatggagaagtacctcttcatcatcaacatacaataatgagatctgatttgtagagacactgttatctgtatcaatcatttttcagaccaaataatgacaaatatacttacaggacactattggtaacgtttttatttaaaagttctgtattctcaatcgaaatttttctttttttgaattttttgtctgaagatggaagaaaagaagttataggggggtgaatgcgatgaccttatcatatataagttccggatatgccggtccgacattggtctccggttccaaatatgctctctacccgatccacatctcctcatccagcggtattccctcgagatatggacctgttggaacgttcatcgtatatggctcatctgattctgttctggtgatcgtgtacgcatacagcatcggggcattgggatcatcaggaatatatcgggatgctctcccttcaaactgggtattatctccagtgaccacaccgtttatcttttcagcaccatatgcgacgatattactgtatactaccttcccgaatgctgcgtgattgacaccgtagctcacagcaaactgtccttccttcagggtaaacttttcactccccagatatgtggcatccctgttctctccatatgcctgctcattattctgcatcacctgactactttcagggaatgatatcccggtcttcatctcctggtatgtgtatcccggatatgccgctatgatggcatcacgtaagtggttcaccggaggcatcaggtcaaattctgtctttcctgtcccccgtatccggagatctgataccgggtaggggtttaatggttgagactggttcggtgtcagccggtaaacacgatacatagtgtacacatcgctcatatactgatcttgcaccttcggtgtatcaaataccccgaccctgataccaaatccgaaagactcatcatcctcctcaagtcccatattcaccatcggagacggtatctgcttgatatgattcatgctcgcagggtatcctgctgctattgcaaaagattggacccgttctgcaatcgtcttatctgccgaatagatgatcatgagaggctgatcaaatccgtctgttcctgtttctgcctgtatggtgccgatatttaatgaatcaccaagcccagcaaatatcattgcccgctctgatccaatcgtccgaaagaccatgaatgttgggtaattgaaaaattttaccccagacggggtctttccgatcatcaagcggcctcatttggtctgagtctgacattaccactcatcccattggggaattcatggtcattggcaaccgtctggcctggtgatcggggaagggcgaatgcatagtagggattatctgcattatttccctccgcatcggggagaacgccgagttcggttagtttaatgagatctaatttttttactgctccctgctggacttcaaatccttcatcagataagatggtaaggaatcgtgcatctgcttcagatggtatgggttctggctcaaagagctcatagagtgtctctttgtctatctccatgcctgccgggatcagatcccgtatgtctgaaaggttctctgtttcggctgatgctccggtaaaaataagggataaaacggcaataaatagcccaataagcaatccttgacataccaaaggatattccaggtattaaaatttaaaaatattatatttgaaggtattgtccctctgaaaaatctcaatttttgaacgaaaaagaaaaaataggataaaattaatagaaaataacgtgaggcttagtattcatctattggcaggatctctgccatgatatcggccggaggagcgaaatacatccatgaagtgaccagcacatctgcccctgcttttgcatacattcctgcattcgaatcattaatagccccggcagctatcatgcagatattcggattgatggcacgacactttcctgaacattcagaaaagatttcctgtgtactcttgtccatctgaactgcatccgctccggatttagctgcaatcaatgcctccttcaggctatgtgcttctataacgatttttctctctttcatcttctctttgactgagcggataacctctggcaggcgttcatatccgccggtaaataacagatgttcacggaagatgaggatggtatcagagagcccggtccggtgtggaacccctcctcctgccatcaatgcttttaatgccatttttttaacaaacggggggtgtttccgggtccctgccactgatattgaaggattttctttctttgctgccattaccagttgatttgtccgacctgcaatacctgaagcaaactcgatcatcgcacttcccgtccgccagataatatggattgcagaggcctctcctttcgcttcaatcagtctgtctccaggttgtaatctggtacctgatgcgacaaaatctccaacctccagtcctgcttttttataaagccggactgcttcttcagtacagcaggctatcatctcatttcgggcgatcaatgcaatagatcctttctttcctgcgagatctaacaggaaggttgtcatatctccagccggtagatcgtcttctatcagtcggtcaatatctgcttcagtaaaataaatcattccaatttcatttaactttggagttatattacatgtatccaattggatccagagacctgcccatctataggatgaagataagagatcagaatacgcttctcaccttcagcgttcagaccccttttaaggggatgacttttttctgttgaaaatatgtaataaattagtgatttaggtatatctgataattctgctgatgtacaacctgacccagatatacccggtaattccaccaagaatatctccgataataagtccccaccagatgccgtgttcaccataacccagaacaacgccgagcagatatgaggcagatgccatgaatactatctctctgagcacattgagaaaaagtgatgacaatccccgcccggttccctgaaagacagaggatgacataattcccggagatacaaatggataaaatatacacatcgtcgcaaggaatgctgctattgatggcgccagatgtgctccctcagctgagtatgaaaatataaacgagatctgatctgcaaaaagccaggtcagaattgcaatgatggtagctatgacaatgcctaagagaacagaaaagttatgaataaccggaaacttttcaaaatgccgtcctccaaatgctgcaccggtaactgctacaacagaggtggatattgcgacaagaggaatgattgcaaacataataacccgccatcctgctgtatataccgcgacagcatcagtattcgctaccatgaccagcagtatattaataaaaacagagagaattgccatcagaaaaaattcacaactggccggaagtccgattgccagaacatctttgatatgcctggtctcatgaaggttcatatcttttgaaaaggtaatataagtatcctttttgatacagaaccagtatatctggacagatgcaatgagaaccagcgatactatcataccccaggccgcaccggcaataccccagttcagatagtagatgaagatgggatcaagaacgatgttgataatggatgctgctcccatcacgtacatcgtccgtttggtatctccttctcccctgagaatgccatatccgacatttgtgaaaaggatcaggatggtccctgcaaatacgatatttccatactctactgcgagatctacagtatttcctgcgccaaacaggaccatcagtggtctgctgaatgtaattagcacaagagatatgacaatcgatatcacgatgctcagaagaactgcctgaattgcagttgtatgagctccatttctgtcccctgcaccgatccttcgggaaattactgatgtagctccggctccaagaccatttgccagtccgatgagaatcataaacaggggagtgatgaaaccaactgctgccagggcatctgccccaagtccggccacccagatggcattcaccaggttataggtggacatgagcagcatggccactatcatcggaatagagagtttgataatggcaattttcggatcacctttcagaagggtgactccggttgtatcaggttgatgatccatgtaagtacttcaccatgatgatgtgattcggctttattctgtctattttaaatccgtactgagttctcccgggtcttcttttctctgacaatgaccgacagtatgagtgccagaactgaaaggataaaacccgcagtcattgagaggtgaaatccgtgtaaaaatttctccggatcaagatcagagaatgctgaaattcctgtttctgcgcttcccaaggtaaaaaatgttgcaaacagagcggtaccaaggacacttccaaggtatactgcagtgaccatgagtgatgttccagtaccctcttctccaggaggagcattttctacaaccctgctggcaaccggtccgccaaaacaacccataaagagacccataatgagaaggccaaagataagtggaataaacccggtttccggaatgattatcataaatatcccgctcgctgcaatagataatactgctgctgctattgcaaatggtcttctgccgataagatcagaccatcttcccatcggaatgcctattattgcggttatgagcggtggaatgaggagaaacagtccggccattgccgggtcatatgccatccctgcctggaggaagaatggaaggagatagaaaatacccatagatacacacccgtaaatgagaaatgcaaggagtgttgcggtaaagttcatgactgaaaacacccggatatgtatcaggagtatgtggcacatccgctcacgaatgtaaaaggcaatcagacaggcaatactgatgctcccactgagcaggatctgcaggtcagatatccccaggtgagaaatgcgttcaagacaatatacgcatgacaccatcaatccaaagagaagaattgatccgtacaggtcaaatggttgaatttcacgaggaatatcgggaggaatgatatacataccaaaagccagaataaggatgccgacagggacattcatgagaaatgcccagtgccaggagaaatactgggcaataaatcctccgattgccggaccggttgctaccccgactgatactgacatggaaatcgctccaaaggccatcccgtacatatcctttggaaggtaggtgacacagagtaatgaggcggttgctgcaagcatagctgctccgattccttgtaaaatccgggcagccagaagaatttcgaggtcgggggcaattccacacgcagcagatccagcagtgaagacacacaaacccaagaggaatatcttcctgatatgtcctcgttcggcaatttttcctatgatgaggattaatcctgccatcatcaggagataggtgataatgacccaggaagctgtcccggtatcggtgttgaatgattctgaaatctgtgggagaattattgttacaatcgagccgtcaagcccgtctaaaaacattccgactgcagcggccgttagaagaagtctttggtggagttgattggagatgatttgggacatggggtaacagattgtgtcagaattcgtgataatagttatgataaaaaattagtcccattcaggttaatactcccataaaatatctttataataaaaatcaatttgatatttcctatgagtaattagcatcgtgagtagaattacgaaattatttggcgaataagagttacgagttctttacatccctgtgatacattggtttgtttctgtaggcatataagtgaatcaggtatttgatgacaaagagaaatctctttccggcttttacttgagtaaattataaatggggtaatgtgtccttcagatcttactatcttatagaaatcaataccgttcaattcaggcatatcatagtctgatattattacattatgagaatattgctttagcttttctaatgccatttttactgatgaaacagtgtcaacctgaaatccttcatatcgctcaataaacacctgatttacatacagcaggtcttcatcatcatcaaccaaaagaacacgatacttggacttctgatttttttcataattggaacactgaataatttgtgattgaggtaatggagaatgaatagaactcctcataataaatcctggaaaataatggtaatctggttgaatagaatgtatcaaaaattttatacaataaaatatgcaactgcttttgatacctgttcagttcctgagtttacttgctgaattacctgctttaattcatctattgaagctgccgattcctctgcgattccggcaatatccacagcttctttggaatttccttcaagaaggttggatatctcattcacactcgcagtaacctcttccaccccggaagcctgttcctcagtcatcgcagcaacctgctctatatgcatggagatgccattaactgattcggctagtttcccaaagaccttcagtgtgtcactcaatgccacattaccatcttttattgcttctgcagcagcctctgcagaatttccggcattctctgattttttctgaagtgaagagatcatttcagcaatgttttctgcggatgttcttgattcagtcgccaaggcttttacttctgcagcaactaccgcaaaccctcttcctgcttcaccagcccttgcagcttcaatagctgcattgagtgcaagaaggttagtctgattcgcaatatcagaaatcagccggacaatttttcctatttgacccatatcctgctgaatttctccaattaaccggttcatatcctctgcactcattgtaatgacatgcattccatcctcagctttcttggcaagagatgttccttccttagcaaggtcattggcattccgggaatattctgatacttcttcagtctttttagagacttcagcaaccgtaattgtcaaatcttccattgccttgagtatctgctgaacaccagaattgccctgttctgcattggcagatacctgactggcactatgtgccatctgtcctgctccctgtgctatctcacctacgttgacattggcctgatccgcatttaatgagagatttttcacctgcatgtttattgttgagatcgcttctgcaaccttatctccaatttcatcaagtgcctctctgaatgatatccagtctcccttaatattcagttttttatcaaaccgggcggtaaaattatatccggcaaattcttttgcaatccgcatagcttccataaccggaatttctattgatgcctgagtctgattcatcccttcgattacttttcgataatctccctcgtgtactgtctgatccacacgaaaagagagatttcctgcaagagcagcatttgcaatctgtgttgaatcgaaaacaagcctggctattgcatcacgtgcaatatttactgcttgatttatctttacaaactgctcttgtgctccaataatctcccggtcagcatcaagaacagtagacgtaaaacttgtatttccatgagatagggataatatattctcatacagattgctgatagatttttcaagatacacaaccatctttttgatggtcgtaatatcgatgtacatcataacaattttggtgacattgttattgacatcaaggatggggatgtaggtataattcaatatttttgttaatgagccgagatcaacagtaatggtcccagttccatatttctttgaagaaatgatttcatttaatgtcgatcccttccgatcaatgacattaatatctcgcagactcatcttagtcaattcagactcagataactgaataatatcctgaaatgccttgtttgatgagagaattttcccatttagatctgttgtaattattccggcaggactatcatttactaaagtctctgattcatgtaattgttccacaagatttgtccgatccaaaaaaatctcaatgactttgtgaacatttccccgtggatccttaataggtatatagaagtaatctacatgacggataccaactgggaattgtacgaccatacttccccctttgagtttccctgaatttattgcatcagaaacactcggcccatctctttgtttgacgatgaaatcctgtagtttcattttcagaagttgctccgctgaatatccgcttaatttagagaaagccgggtttacatcggttatctgtaaatcaagatttaaagtaaatattgcatacgggttttcagatacaaaagttttattctcttctatgtatgttttcagatctgttaaatcattatatatgcacaatattttttgtatcgcattgtttacatccagaactggtaggtatgtatattccaggactttaatccggtcaccaaaatccaccaccatagaaccatatcccggttttttcgaagaaagaacatctgaaaacatcgccccatctctggaaatgagcttgaaatcggcaaggttcatcgttcgtaatgtttcttctggaatctgggtgagattcataaaagccttattaaattggaggaaattccctttgagatcagtggaaataatacttgtgggattttctgatataagtgtgtctgattcatgcaattgttccacaaggtttgtccgatccaaaaaaatctcaatgaccttatgaacatttccccgtggatccttaataggtatatagaagtaatctacatgacggatacctactgggaattgtacgaccatacttccccctttgagtttccctgaatttattgcatcagaaacactcggcccatctctttgtttgacgatgaaatcctgtagtttcattttcagaagttgctccgctgaatatccgcttaatttagagaaagccgggtttacatcggttatctgtaaatcaagatttaaagtaaatattgcatacgggttttcagatacaaaagttttattctcttcaatgtatgttttcagatctgttaaatcattatatatgcacaatattttttgtatcgcattatttacatccagaactggtaggtatgtatattccaggactttaatccggtcaccaaaatccaccaacattgtccctttttccggatttttagagtttagtgcatcagaaaatgttgctccttccctcgataataatttaaaatcagcaagattcatcgttcgtaattgatcccccggaattctggtaagatccaaaaaagagttattaaattggagaatattgccattaatatcagtcgtaataatgctcgtggggttttcagaaatcagggtttctgattcatgaagtttttcgaaaatgtctgtctgatcagcgaaaatgtcgtatatctttattaattccccattggcatcaaaaacaggaatgtaagaatattccatatgtctgatacctgttggaaattgaacgataatttttccggatactgtttttttattcttaatagcctcttcaacggtttgaccatcccgctttaagatagtaaaatctgaaagatttttagagatccattcttcacgattatatccggaaatcctggaaaatgccgggttgacatcggcaatggtcaaatctggattgagaactatgagagcataggggtttccatttatcaacgcttcgatttcctcttctaaaacattaccggtgttatcaataactgtggcaagtacacatgtttctccctcatatatcgacgttgataacgttacttttgcaggaaatatgtccccgttcaagcgtttatgatcccagttaaatgtaacactgccattctgacatgctaaaagtatccatttttttatttcttcgttgctattttttccatttctttgaaacggtggagaaattatctcggggctttttccaattatctgatcagggttatctaaatgaaaaacgtttagacaaggtttactacattcaataaagataccgtttgaatttagaatgaatattgcacaagggatctcgtcaataagtctctgaagtgtggagacatcttgtgatcggatcattgaatgagtggttatggtcatttcttcaaccctttcttactttatgtctgatttttagtcagtcgtatgaaatatatattcatacagcttattatagcatatcttaatggcgccgccatacatatatttatatattgatttgttgggtatttatgtatggatgaaatccaaaaaaagattctctctgctctttctcatactaataaaccactaatgattaaaaacattgcagaaataagtgggattaatcgtcatacagttgcaagaaagggtactggcctcctttagaactgaacatggtagtttaaaaactcactccaattccaaagatgatcagtaatactttctaacattgctggagacttgtgactactttttacttcgataaaattatgcacaaattgaaagatatttagcgctgaaatgaatctattgagtttttttgaaaaagaggcagttttccttccaaaacggctcaatcgttgtctgattttattattgtagccctcaatgactgaggtagagattgctttactatctggatttcccataattttctctcgaatgacataaacaagtttattcttctcttttactttgatcacctgaccataatccaagcatggctcacaatataattcaggtaaacaaatgctatattggacgtttccatcagtaaaaatcgatattttgttttctggcgttggaagttccattcggttaaaaaatcgaactaacatatctgcacaagtatcaatatttctttttccagattcaaatgctaaaaataatccagaatcccttttaaaacaagtataggaccaacaatcacctaattcttcagagtcagttgttaggagattcttgtttttttttgaacaaactcccaaatttcatccatctcacaatcccccgcggaaatgtcatgaataaaataatcgttgagtttttcagcatgttcaccgattaagtgataatatcgagatatagtgtcgcgatggtgtccggtaactcgagatactcctcgaattgaagttttttcagtcgagtgtttcgcaattatgagaacagcagttcgtggtaaacgagaatcatacagaggagtatttttagtttcaataaaaaaacgtcgacagtgatggcaatagtactgttgattgcctgcagaattatgcccatttttagtaatattctttccatcttcaatttgaaaataagtacaatccggattttgacacgtaatcaatataggaccacgttttccaaccatgaaaataattatatctaaacttatattaatttttagtacataaaatttaatactttatttgcacttagtattaccagcttgctaacagggcactacccaagaaagctggataccttagaaattctcggaagagtgcgaaagatcgagattgggtgtgccaaaaaatatatgcttgtagagaccgtccctgtttcaagtctgattgatatcagtaatgacttaatcattattttgaatgaaaaatgggaggtgcaatatatgaataaatctgcattaatcttttttcaccagtctgataaaacagtgattgggaaaaggatagactttttgcatttggagattttttcatctcctgaatttattcagggattgaaagaattctctttccaaaaagttaaaaaaatggaacttgaaatccataaaaatgaactctctcattggtatgaaataacaattatgaatatttcaattcggccgggctctctttttattgcagtaattgcatcgaatataacggaaacggtagtaaccagaagtaaaataatggaaaatgaggcaatgtaccgatcactatttgaatatgcccctattccgattaatgaagttgatttttctcaaattaaacaatattttgatgaattaaagaaaataggcttagaagatatcagattctacttggatcaatatccggatgaattgataaaatgttgtaaccttgttaaggtccgacatataaatataaaaagtaagaatgattatctaatcaccgggggtgattactacaatgtcatgaaatatctgacacccctattcacaaaagaaacaatgaataatttaaaagaattgtttgtttccctatatgaaggcttggattatttttattttccttcatctgttattacttcaaatggaaaatttcggtatttctcaaactatgtttcggatgcatcaccaaacaatgatctttcgagaatatatatatcttatctggatgtaaccgaacaaaaaaccctacaattacaattactgcaaaataataaagatctcatcggggtaaccgaagaagtaattgcccatgatgcagaaattaaaattcagatcgatgatctgaaaaatcaacatgatgatgctcaaaaccggactattctctatactcaactattagatgccactcatattcctgtaatcatatttgattcatcaatgatcatcacttgggcaagtactgaaatggctcgattaatgggatattcagataatgatttatatggaaaaaatatcagaatattatttccggatacgaatgggttcaaacaattctatcagtttattgttcataatgaatctaccggtaaatatggtgaattttcaatcttacatcagtccgggatatctttaccggttctgtggcttcatgtagaaaatattacattatctgatggaaaaaagacttatgcgacaatagttcaaaaaattaattcatgagacaattgagtattctccagtaaaaaatccgaagaccatttctgacagttaaatttataaaatgcagagaatcagattcatcttgacttcaaatggatcattcagtaaaaaatttatggcaatacatttctcatccggagagcaatttcaattacttcagttctttcaagaaagccatttccgggatcgagaaagagatcttcgtcatcgacatccaggatagaaatcatattctcctgaatagtatctcttcaggttcattattgggtccgaatcagataattcttctgatgatatgattcagatttgacctgagttcatctggcagggttagtcgccatatacctcatcaaggtactcctgtaattccaaaagttgcttttcacgaaatttcatggcatttaattcattcctgaccatctccaagaccagtgatggattcgcatgccagaccggagcacctcttcggggagtctcttttgttaccagaccctctgcttccagctcctttaagtgagatttaaccgaaccttgaaaagagaacttgaatacatccttcatgaactccctgatttttggttctcttacaccatccggagaaccggaaataaaatagagtatctctcttttggacaaatttctggataaatcacgccatatcgtccggtgatgatgatcctcttctccctgattcataggttcgtaatgatcagatctagatccgtattagaacttgtggttccatataaatcagatttggtgatattgtcgtatttctgaatgatctcctttaaccgggtgatatgctgctctatcgggccacattttgatatatagtgaacatactcttgtttgaaaatatctgcagatatttcttcatggttgttagaggtataaagtataaatggtgtattaattccctgggagcggagatgtaaaaggaactcagccccattcatatcaggcatttcataatcggataatattaaatccataggatgggtttttaaatatgaaatggcattttttggggataaaaatgtctgaacatctattgttagatctctctccaaaaaatgtttcatgacatcaagcatgagatgattgtcatctacataaattaatgaaagtttctctctatccgaatatgatttacctatgcagggacgattatgcacaatgtgagtttttctttagtatacttaagacagagaacaacgataagctataacgggagttttatatagtgattcatgtaactattttctgacaatgcaaaaagagaagattgagattcttcgtaatacattgcagaatgtcaaaaagcctctttctattgcagaaatatcaaggttgtctgaattatcccgaattactacggcacgatatcttgatcagatgtacctgtcaggtcaggtgaagatgtttgagattggtaaggctaaaaaattcatcctgagctctgaacaatatacacataatctctatgatctctctactaattttgtattgattcttgatcaaaaccttcgtgttgtatttatcaatgaatcatacttgaaaaaaatcaagatttttaaggacaatattattgggaagaggatacagtcattaaatctggacatcttttcttctccggaaattctatcattgctacatgagtttcgtggtgagggtgttgcgcagcatcatgttactattgaaataaatgatgcatctcatgtgtattctgttataattgcaaaaatttcatttttaacaaattttctcgcaactgccatcattgctcaggatattaccgagaaattcaaaagtgatgagaaactccattttttagcctcaatggtctcttcatctgaagatgcaattattggtattgatcttcatggaattatccggtcctggaatgatggtgctcataagatatttggatataaaaatgatgatgtaattgggaaaagcatttccctgatttttccgcctgaaaaagaggaggaatatttagatcttttatataaagtaatggcaggggaattaagtgttctaaaaggaacctatctgctatccagaaataatgtcgatacagatatctcgtacacgatctctcctgtaaccgacgataatggaaatattatcgggttatcaattattatcagggacattactgatttaaatacgatacaaaaagcattaatcgtctccaaaaaaaagatcaagattttatcaggcattacacgacatgatatcctgaatcagcttcaggcacttgatgcattctctgacctgataaagccatctctagtgaaagaacctcaggctttagaatacctacgtcatatatcaacctgtagtaataaaatcagacaacagatacaatttacacgggaatatgaggaaattggtgatagtgttcctatatggcagcctttagatatggtggtaaaggccgcagctattgattttttgccagaaacgattgttctcaaccttgagattacagattatgaattatttgcagatcccatgctgatgctcgttttctataatctgatggataactcaattcgtcacgggattcatgttacaaagatcaacatctctctcgttgaagatgtatctgggatggctgtccttgtttatgaagacaatggaattggcattcctgatttattgaaaaatcaaatcttcgaaaagggatatggcaaaaatagtggtcttgggttatttctggtccgtgagattctggaaatcacaggatttgagattaaagagactggcagggaaaacgttggagcacgatttgagatcaccattcctgcacgggcattcaggaagaatcgaacatgaatagtgtaattatcgtactggtattctcatggtaatagaacttttatcctatgatgtcagtcctatcaacaatctcctgaaaatagtgattacaatcgggtttgcattggcaaccttcatcctatttcagtgtcaaaaaagatatggcggattattgcatcagatatccattctgcttttcatatccgctattgctgcaacattctcctcctattttagattccagggtgacttttatacttcctataagtggggagagagtattgtcggcttgatttttattgtcctgtcccttattattgcattaatcatccgaaaaaaaatccaggccattgtccatctttttgaagaaactaagggttcagaatgatagatttagaatttatggactattcaactagtccattcaaccctctattaaaaatagtcatcttcatttttttttgtgtaacagttgtggtatattatgatgccaggagaacaattggtggggaaatccgtaaaataatagatttacttctcatattttccctctttatggctctcggttccttcttcagatactttggtcatggcactgattttggttttaattcagattattcattaaagtggttccagagtattgcgtatctgtgtgctacactctgttttatttacgcttgtgtgaaactgaaaactttgttccggaggagatatgagtaatattcatgatgaaattattgacattctcactccaataatcggattcggtcttgcccgtactgccgtttctacacaatgtaaaaagatgggtattctcccggaagagttatcagaaaaaaatattctggaattttcagaaagatttgagaaagtcctggtaatttttgcaggagatgaggttgccttgactatcactcatcagataaaatctctgaaataataaattatcataagaagatataagatactggaagatatctatctttatctatctgattaaagatatctggactctttccccttttctatacccgttgctccactccggaagatggagtatgccgtctgcactgatgccggttatgtatccaaattcccattcaagagggaaaatacgtataacgccatcttcatatcgcgttctgacaagataaaagagatcatatccaaagaaaggctcaatatcccgggttatctctccgatgacatgttttttcggaggtatgggaactccccaggatttgagcagtgggaatacaaactggaagaaggataataaacaggcggcaggagaacctggcatgccaagaactggttttcccattacagaaccacagagcaccggctttcccggctccatggctacaccgtgaaaaagaaggttcccggccttttctatggcatcaacagaataatcctttgtgccggcagaagttccccctaaaacaagaacgatatcacaagtatcacatgcagagagtatccgggatgcaataagatcaggttcatcaggtgttattggaaacccttcggtgagtacgccaaatccctgaagatatccggatatcattatcgtgtttgtatcaacgatctcaccagggtgtggttcctttttcgatggaattatctcatcccccgtggcaatcatcccaaccttccagtgccttaccgcgacgtcctttacaccgaaatgaatcagtgctgcaatatcatacggggtcagtacatgatctgcctgcataattatctgacccttttcagcttctgatcctttcggtatgatatgctgacggggagagatcggttttgagatcaggtactggcctttttcagtttttcgaacctcttcaggggagatgatcgtgtcataatcatcaggtacaggaaggccgatatttacggaaatcccggaaacttcacggaggtgctcattcgatgcccccctcgtctctttgcttttcagagcgattccatccattcctgcaagggtgaccggagggatggtcctgaatatactgacgggatctgcaagggtatacccaagagcattttttaccggaatgaacctgctttttgtttgatttttaaatgaggataaaataagtttttgggcttccttcattgagatcaggctatccggcgaaattattcggggcatattctaatccaaaagttataattaatctattgacaaacataaaaaagtagctgattgctggaataatgtgagaagagacgggatgatgtatccaggtcatcattgatacgccaatatcgatacctaagttcctgaaaccgatttgtctctctgaaaaatctaatattcataaatttaagcatacacctgcatatcatagtgttgtgattctcatgccttgaataccgtctttgatgaatcgaaaaaataccaaactctgttcactccatacactttagcgataagaaaccggtttaccatattgcagaacgttttgtgtatccaatactgtctgctttctatcagggcgatagccataaattctgaacattccttcactatgtgaggagtcagcgcccatgtgttatacagggacttgaagattcactgctcacagaattcaacagatataggagttttcatggggttaaatgcgaaaattggttcagttatggtagtactactctgcatctggtgtgtttcagctcaccaggagattatcatcggcacaataatcgatgaacaaggagactgtgcttcatatgcagcgggagtagaagcggcaatagatcttgcggtttcagatttaaatgacagttatgcgaaatcaggcctggataccacagtcacgataataaaatctacctccaacgggacacgggagagtgctgcacaggcagctgaagacctaatcagtcagggtgccagggtaatagtcggtccttcttcttcagaagaagtatccggcgttctcccaatcctcactagtacagggatattctcggtaaatccatcgtcatcgagagccctctctctccccggcgatccgatggtaagattatgtcctgatgattcaaacctgatgaaagcggtattaagatatcaccagatgaacccgcaggactctcaaagaacaatgatcgtgattcttgcacgggaagatctctatggtaaggtattgagcgatatgttctcatcatctgagcagatggcagatcctgttacctacccggctcatacccgcgactttacccaggccctgaaaactcttgattcaattgtagatccgatgattgcggaggtcggagagaggaatgttaccatcatcgtcgtctccctggatgagacgggtgatcttctggcacaggcatccgcctatccaggccttgacaaagcacggtgggaaggtatggatggtgcagcacttcatacaaccatcctggagaatgaaaccgctgcagcgtttgcttataaaaccggattcaccgctctttcatttaatatcgctcagccgccggtatcagattattggcgggtttttgatgcagtaaaagatgcaaaaggggggaaggtcccctgtatctatgagatccttgcatatgatcagaccctaatggctgcatggatagaacagaataaccctaaaaatcctgaagagatgctctatatcgctgataattatgggaagtattcctatgctgcaacgggttggctgaaactcaatgaaaacagtgaccgggagtttggggattattatttttacacagtggataaatccgaagatggatattactggaagccggtctatgtatacaagtatgaaagtgatactattcaatccctgaatggtatcaacaatacgttcatggaacgatttttggagaaataaacctcctttttctcaatagcgataaccctttttttacatgaaaaccccgtggtttcgatccctcgataatattcatatacccttatgacatctatacgtgtgtgagcaatcatgttctgtcatcagtgtggagctgaagtatctgaggggagcaaattctgtgaatcttgtggagcacaggtcaaccaggattttgaatacaaatacgaagaaaaacaaaccgggcagaaaacccactataccttatctgaaaaccagaagaatcccacccttgctgccatcgcaagttttctctggtccgggatggggcaggtctataacggaaacctgttcaaggggtttgcctttctcattggtgctctgattggatcaatgatatttcttataccaggtatcatcatctggatcttcgggatttacgatgcatataatactgcgaaccagatgaatcgtggagaaattccctatgtggaacacagcatgggccagatcatcatatttgttctggcaacgcttgcattaattgtgatattcttcatatttggccttgccatcgcaggattctgaaacgtgaaatcgcaaaggggtggtgatcgtatgaaacattatttcattctggtagtatggtgtgtttatctcgtatgtgccggctcttcgggctgggttccgactcccacccctgacatggatcagctggaggcagaataccgggctgaggagtatgtcctgtctgaatatcacaacctgaccggcaagaccgataaagaggctgatcgtcttatgcttcaggggcttatgctctcacaatcgggcaggtatgcagagtccaaagagtatttttcaaaggtcaccacactgacaccagacaaccctgatgcctggtactacctggggatgagtgaataccggctcaatcagtcagaaaacgcaataaaggcctttcataaatcacttgagataaatccggactttgcctatgggtactatggtctttcattggtctatgcacagcagggagatatctggaaacaatcagacgcactatctcgtgcacttgagatagaggagaaagccggagttgagtcccataatcaaggtgccccggtacagacaactcccgcaataccactctgcacggccactgcaataattggtattctctgtgcaggaatctggtttgaaaatcataaacggtgatcgtatcatgcatcaaaaccataccggggaatgtgatccatgacaatacccaaaggatatctatacgggccttctctcctgattctcctctgtttgttttgtttaatggtgccagtatctgctcaaagtgatttttgtcctggctctgtgatgacagatgcatcagccgcctgccttgagtgtgcgaagacaaaaacctgtacccaggatgaacggtgcatgagggcacaatgctgtttgtgcagatgttatcccaattgctgtttccagcaggctgaaactgactgctcccgattttcctgctcctgtaatgacggagggtcagtttcccctgatggtaatggggacgggacttttattattctcataggcggactgcttgctgcagggggaatcggagctgctgtactaaaggccaggaataaacctgctgcaccggtacagaagggtacggctttgaagaaagaagaggaaaaggagaagaaggcggtcaggtatgttctccagttatcaaaggacatggtccgggtatcaggagataaaccagactcattttccgtcaccgtctggaaactactcgaaaccggcgagtatataaagcaaccaggagcccctattcaggtatcaggtccttcaatacccggacttacaatccggccatcctccggcatgggaacccttcaggtcacagtctctctttcaaaacctgtaccggttacatctgctgaactgaccatatcagcatcagccggagggatgacacagaaagctacggtgcatgtcaccatagagcagtcattacaggtcggatttgagtagggtggtgaaaagggatgaaattttcaaaaccaatcccatatcatcccgacaccagaacacttggcccggtcagtatgaagatctggttttaccttgctgataacaagcgggtgaaactcaatcatgcatccgcctctctgactccaggttcaggatgggaaggactcgttgacctcaaaacccggtacatcctggataacacaacctttcagattgatgcatcgctgaaaaggccactcaggttatccgagtatcagggcctgattcttacaaaaagatccattcccatccagagcaccctcacccccgaaggttctgttccaggtatggggataccggtcccaattggtggagcaccggtcatcgatcagattgatctcaccattcctgatatcccgcatccagagctcataacagacgtttactatgccgggaatgatgaatccggtcatcctgttgcagtggtacaagcgacagtcaatctcccctttacattcaccgaagaggagatagcagggattaccgagtgtatttcaatatcggtgaccgatgggagaactgctatcactgaaggtccggagataatcgaagggcaatataagaagcgattcattaccggtaatgctccacctgatgtgatgcaaaaatctggggtaattgttaccgttcgttcgtcggttgccggtcttttactggcagaggaggtttctctcacctttgccccctctctatcctatatcctcaatattaaaccctcacggtcccttttcgtaaccgtaaaagatcctgctcatcttcatgccgaagtcttttcgcaggatgaatcaggaacgctccgacaggtaccagatagcgaattacatctggatcttccgtcaggcatatcagaatttttatcagtctctcccataacagccaggggtgtcctgaatgcagccataacacagacccgtccgaccaatctgcaagagatcgagttctccctcaacgcttcggttcatgaggacgccgtacccccacagacgattacggtgcatttcaacgcccctgcatcccgatcaatcgagacacgattcgaaagtgacaaaaatgccatctctccctttctcatacctgatcgtgcaatcctcctggtcaggttcagcacagacgcccctgaagcaccgatctggacctttgaacgggcacaaccggatggatggcttgatgaacccagcacccccgttgattatggtgacggatggactgcggttgctctaaaggccactcctccggaccctgagtacaccggtgatcctccggcatcagaagatatcattatcaccgcaacttcagggaatacccgttcagggcccgtctctgtcccggtgctgctcctgaaaaggccaacaatcgaggcagatacctatcaggtcacgttggtgaaaggaattaaagagactgtgagagttcaggtccgtattgaccatggcggatctgaatcatgggtgtttgcaattgatcctgaaaaaacgctcaaacgtgtcaatgcaaccattaccggtctggatgatacccatgcagagatagccatgacagagcaggactcccctgatgagcggtcagagagcctgtatgattcagagactgtcatcgtcaccgcatcgccccggtcaggagaactctccttccctctggaatgccatatagccgtcattatctcaaaagagggccttttcatagataccatcgccagacggaaggataccggaatgtatcatgtcccggtgccgaattcacagatggattcttccgctcttctggatttttactacctggtcctcactgaagataatcagataatttctcatacttctgccatcaccgacccaagccctctggattttaccaccatggaggatgaaaagacaaaaccctataatgcagccaaaggatctggtcttacctttgtgtcctcaggagtgaggcaactcaatactccatcagcggtctattcagtctcgatgattcgtccgataccctttgacggaaccccgattccggtcagatgccgtgcaacggtccaaaaccatgccggttctgaagagaccgggtattgtgacttcattcttgcccttgagactgataatgtcaatccggggagtgccagctgggagattgaagtccgccggtgtgaacgcatcatcaacaccatggcaccagagcaggccagaccagaacttcatacactcctttccaaacgtaaacaggtcctcggcgttgaggggcttgttcagctcagatggatgatctataaccgggcgtaccggctctgtcttgaggaggcacaggattacctggatgcagcaaaccggtatgatcagatcatcgaggccctggaatgggtaaagtgggccggagatctcgccttcaatgctgcccttggaacggtggtcggaccctttggggcgatcgccattaatcatgtaaaggggaagatcctgggtgctcttgaggcctaccagatgggaacacctccggagtcttttatcagtttcgatgatatcaagggcataaccgaaggaaaacttatcgatccggatcaactggcaaaactcaccggtgagcggagatggcttgcatgggggctgtttgccggctatcacttcctgaaaaccctcatttatggagaccccccgaacaataccgttgtgggagctgcaaaggagaccgcacgacaactgagggatgaggtcattgcagactggctgaatagtactgtaaaagatcatggaacaaagcaggtatcgggtatcataagaggcgggaaagaagagacaggcggaaagaagaagccagatctgactcagaaaaaacccgtaccggagggaaaaccaggagatgaaaaagcaaaggaagagggcaaaacgaagccggatgaagtgaagcaaaaagaggaaaccggaaaagagaaggaaagtccggaagggaaggataaggaggataagaagaaacccgatgagagacaggcaaaagaagggaaaaagacagcagatgaaaagttaaaggaagcaacctctgaatatgatcggctgaaatctgaatatgatgccataaaggacaaatcatccaaagaagcgaaagaagcagcgaaaagacgtgataacgcacgactggctatggagaaggcaaaggctgaatccctggcagataagaacatcgccgactctcaaaaggaagtggatgcacgggagaagatgaagttcgaagaagggaggaaggaaggccggaacaaggtcaatgagctcaaagatgcctgggagaatcttcagaagaatccggatgatcctgctgcgaaaaaacggttctccgaggtctgtgagaaggtgcaaaaggacaagcatgccatgcatgttctcaatgatgaaccccacatacttgatggtaaaaccagaaaacccggtgaagaaagtccgctccgacgagacttcaatgaacactggaaacagacctatgacaatgtggaccggagggttaagcaacgaatcgcagaccagctgaatcagaacctgaaaccaggtgagagaccatatggtccggatgatattgagattgcaaagatcaccaatgtgaaagatgcgacacccagaactccagaccaggagagcacgaaatccacctttgaccgtgatgtcacctaccgaaagccaaagcagcagatgaggatagatccccataccggaaaggcagtcatagacatgaagacaggccagccggtgtatgatcctgtcatcgatcccaggaccggtaaaccggagatggaggatgtcaaaagcacgaatgaaccggtcagggatgtgaagggaaatacacggacggagaacggaaaacttgtagaacaggagggaaccggctcacgggatatctacaaccaggaattttaccgagagcgacatggagagtacccgtataagactgatgcaagcggaagagtcatcacggggcctgacgggaaaccggtcatcgatcaggcaaaatgcaatgaatatgccgaacatatggatcagaccgttaccgaccggttccataccgatgcatatggaggaggaaaggaggatattggcccggcaacacggggagacatgaaaggaaaaccctacaaggatcttgaagcaacaacccgtaccatggagacgaaggtgtatgagtggtatgaccgggccgaaagggcaatgaaatctggagatcctaaagctgccggggcgtacaaggaggaaggaatgcgacaactgaccaaacagtttaaaaaccagattgaaccggttgtaaataaatacaacgaactagccgggtatccggatcctcccattgcacgaatcccggagaatgtccgtgccggtgttgagatcatgaaccgggttggaaaagatggatttactcctgcagatgccgaggcagcccttgcccatatgggcgaatccccacggagcatcattcagaagatgtcaggaatccttgaatcaggtcagaaacatatgtcagcaggtcagagacagcagttacacgaatatctgaagactcttcccgatgagtagaggtactctatgactacaaaaaaatgtccggcatgcggtcaggataattcacaaggagcgaagttctgcagatcctgtggtactccactccagactggatcacacggtgttggtccggatgttggcaaaagcaccggtgattccttccaaaaggcgactgagatccttgataccgtcgcatccaccgcttctaaaatagaatcaacggtgacaaaggctgcacagattggaacggctgcccaggagatatcgcaggtaatcatccgtcccccggctgaatggcaggttgttgtcggagacatccttcctgctgcaggtgagaagatcgtggaacagggaatggaaacggcagaagagagagttaagcaggtggtaagccagaagattacagacgttctttctgacacccctctgtccggaaaaagtgagcctgatcgatttaataatctccctgaaacctttgttccggttgaaaaacccctaaaatcaggagcgaaccttctctgcccctcctgtaaacaaccggtaaatcctggtgcgaaattctgtaaaacgtgcggggcccggattcctgtcaaaaaaccttcatccccggttcagaccaacgggatagatccaaatctccctgtctgtacttcctgtaaagcgccactctccccaactgagaagtattgcaggcattgtggagaaccaacagggtcctttgcccgccacggcatggagggatccgtgacacactgcccctcatgtgggaaagacctgaaaccaggagcaaaattctgcagacattgtggaacaaagatatgaacggatatcatcagaacacaggtgataatatgaacaaatgtcctcattgtggatcagatctccctcctgacagtgcattctgccaggaatgtggaaaaccggtatcaatttcagaacaatcatcatcggactcgatggtctggaccgcccagataccggtgattaccagttcggttgttgtcagacaactgggtatggctctgggtggagggtttcttgtggtgtttgtcatcatcctgttcgcccatcccggagctgcactctctgtcgcacccatcctgtttgtcatctgggtcttcttattcggactgtccctgttcatcgccggaatataccagaaggcaacgaaaggggggcctgatgcagtcttcgccgtgacccctgaaggaattggctatgctgcaggggagactatcaaaaagatcaacaggcttactgccatcggatctgttgccggcggatcactcagcggccttggaggcagcatgataaacatctcccgtgagatggatacaattccctgggatgagatcaggtccataacgtaccagaaccgggagcggaccatcgttgtgtatagaaaaattctgatctctcctatcatgctggcgtgcacgagagaaaatttcaaccaggtaaaagagctgatatcccggtatgcaccgcccggaacgatcaaagaataatgattattcccggtacaatacaaataccagaatccgtgtaccaatatatccggtacctgccagaatgagagctacttccgcatcatgcagaatcagtgagccaaaaagcatgccggaaagggccaccagacataccacgaggtaccgaagggttgcccactgaataccaaaatgccatgctcccctgatcttcatatatctgcattatcagagaaccggttaaaagtgttggtaaaatgatgagagattcctgatgttatcgtacaatcttggtgatcggtatctccaggatatcttcagccccggcagccttcaattctggtatcagagtatttaccttactcttcagaaccacagtctcaaggctgaaataatcgataccatggagctttgcaacggttggcttctttaatgccggaaggtttgcaacgattgaatcaagtgatgctgccgggacattcatcgagatgagcactttattcctggcatcgataacgcccataaggagggttactatctcttcaatctcctttcttttgaccggatcctcaaaacttgcgatatttgcaatgatggtcgtatatgattccatgatctgcccgatgatcttcagaccgttcttccgaagggtcgttccggtttcagtcaggtcaacaaccacatccataaggtcaggaacctttgcttcactggcaccataggacgggaagagacggaccggtatgtttaacttttcgaagaattccttggtcaatttaggatattcggtagttatccggctatcagggcgaatttcactcacggttgagataggctcactctggtggacggcgacgacaattttgacaatacccggtcctgttttgctatagttgagttgtgccacctcttttacctgtgctcctgattcatggatccagtcaaggcctgatattcccatatcaaaatatcccatctcgatataggtcggtatctcctggggtcgcaatattttgacctttcctatccgtgcatcattgatttgaggattataatcacggtcagttctcctgacctcaaggtcggcttctttaaaaagctgaagggtctgttcttcaaggctcccttttgggagtgcaatgttaatcatagaacaatagaaggagcgatatgaattaaaccctgacggtttgcatctgtgttctatctatccctgaagaaaatgctgaatcattatcgaatataatgttccacagagaattttcggttgtccgcttgtccctgttgttcctcttctctagaaatatcgttaatccacgataaatattgagttataagaatgttcgggtgaagagggatctttagtcaatgcatacttacgatgcatacttattatgttcctgaatatgttactgaatacatactagattagcattaaagaggtgtttctatgaacattaatcgggagaccatatgaagaggccatcaggaggattatcgataaagggtatgcgaggaatcaaaccgaggtcatacgacaggcaattctcgcatatggaaaaatgctcgaggaggaagagatgatgctggtcaatagaagtgaaacaatgtcgccattgaagtttggacctctttgatattcttcccatgaaggtttttgtagctttctggctatttttgaacttgaaatgaattgtgagaggatatattggatgtaatccgccaatagtctgatatataagatgacattttttgcctttattaaaaaatgaacagatttaaacctcatctgatcaaactgtacgagtatacttcttattcatgtaccagagagatggaaaccatacaatgattacgataaaatttgacgaaaagggattggttccggttattgcgcaggacaaaacaactaaagatgtactgatgcttgcatatgccaataaagaggctgtggacctgacccggtcaaccggatatgcacactattacagcaggagcaggaataaactctggaagaaaggagaggaatccggtcatctccagaaggttcatgagattctggttgattgtgatgaggatgcggtcatctacctggtggatcaactcaccgcagcgtgtcataccggataccggtcatgtttttaccgaaggcttgacgggaccgtctctggagagcggatgtttgatcctgatgaggtctacaagaaaagtgaataaattcatctgaccatttggtgaatatgggagggtcattgaatcgacctctttttttatgaatttatgacctgcatttttgatgctttttttcagagtggcagtattccagatatggatcttgtcagatatcatcccagactctctggtgaatgtttttgcaatggccagatagtgcttgtcacgacgtatccgaaagatgttactttaaagtatgttattctggagtaactcacgtgagagtaacatgttgtcttttgccggaaagaggagatcggataatggttatctgaaaaagccctgtttcagttattattttgacaaaaaataatgcctattctaaccaatactgaatatgaaccggaagatccccggaactctgggcctcatttttggaaccatcgccttcctggttggaatattttcattctcacaggtatcttattatctggccgcaggatatctcctcgtctgtctttttgcaggaatgcttattgtcagagtcttttgtgcatcctgtccgatgaaggggacatgtgttcatattcttcccggttatgtggcacagttctggaaccagctacccggaccatattcttccgggaaaattatcctgaccgggattctctttgcgataataattctcataccccagcttgttctgatcagatcactctatctgtttgtgctcttctggatctgtatcatcattgcggcaatgagcagttatctggtcctttgccctggatgtggcaatcagtactgtccgtttcgaagagaaaagaaagagcagagatgactcggagattaattcagcctcacttaagttcatctctgcccgttatccaaaccctgcctgatatgtcccgttctgtgagcagtacagccagtacccgtggtatggtcgtattggccgttcatcgctctggtgaccggttcctcccctgattatcggttcttcgtactgctgcacgactgcgtcatacccggtggcatatgaccaggcattcatcagggtgtggaatgtctctttcgctgaaagatccttctccatccagcctccaatcgatgaccatcctaccggaatctcccgggaaaaaggaataatctggtctgtaaacctgaccgggacagttatggtattggttgaatagatccagtatccctggaggggaaccaccggatcattcattgagagcgttctgtatccggtggtattattcacatatacaaggactgaatggccggatgagttcaccccggcaaatatttgtgcagtatcatatcctgggttgagtcgcctggggatggatacatgattccatcccggataaagtgggattccatcggacttcttcagagacttcagggctgcagagaggtttacccgagcaccggtgatggttttatcctgcagtgacgggagtgggtcagcggtatccatgatcacctgttttactccttctgccgtaagatcaggttttttccctttgataagaccggccattccggataccatgggagctgccattgatgtaccactcatgtactgatattcaggctttattgcttcaccccggtatccgatccttatatttctgatagaaaagtctgatgtaacatctctcttaaacaggatataggtatatctggtcctgaatcctgattcggtatagacagaattaagcgggatgaagagttgtctccagtgatcttcgtgaaattctgtatcaaaatcccacaaggatgtccaatttacaatatcatttgagtattcaattatctgatacccaaaaaaatcaccttttacctcccagatcagatgagggattttattttcttcagaagggatatcaacagaggtattcatctcgatgacaaatgtagaaatgtcaggataatctgagagaactgcctgtaatgacacgggctctcctggcatggttccaggaatgcgggtccagttcccggtaagcgtaaaattctcctttgcaaatgtggggtcttcaaagaacgaagtataggaatatccggatggaatggtactgtatatatcagtacccggagctccaacatggaccgtccgattgccaaaattcgaaaaccacgatagttcatcctgtggatcagtggcagcgaccgctatcacattactgaagttataacatgccggatactggggaaacatattcagatcccctccataatttcctgctgagcagacaaatagtgcaggagactttcggataatatcctccattgtccggctgtacggtgttccaaacgagcaactgatgatcgaggcattatagagcgtggcatacgccatgccaaatgccagatctgatagtcggccatggcctttgtaatcaaggactttaatcggcatgatagtagcattccaggctactcctgcccctccaaggttattattcccaatcataccaataaccccggcacaatgggttccatgaccatcatcatcccagggttcaaccgctatttcctccagagcgtttaatccatgcagcaccagccctgattgagacatgctccagatatttccggcaaggtcagggtgaccaatatctgctccggtatcaagaacggcaatgataatcccattcgttccggtggtttcattccatccggaaagggcactaatatctgcaccggaaatccccgggctggtattttccttaaaaggagttccggtattggaaagcccccattgtctccagaactctggatcatccggagttgtgtgggcactgacataataatctggttctgcataggctacacccgggcattcggaataataccggactgcatcaggaaccgaaatagtgtccggaagagtgaccagggataatccggatatgccgatggtcccataatcgcgtttaatcgtcgctcctattgctgcatgaatatctgaaagggaattgactgatccgtctggatttgtatttgcctgcacaaggatacttccattcacgtatggaggatcaggcagaaaattcggaattccggtagcattcgtgaaatatttaatatcatctgccagaccaaataaaaaggagagaccgaccaggcagaccaggaggcagattactttgcttagtatttttctcataaaggtgatctcagtgaaagaatatggtatcttcattattcttatgcttttttataaaaaattctctatcaatataaaccactgataaatgcaggtatgttgtaaataacatgatattcggtcttttctattcgttcattatttgattattttctcatcagcaaccatcaatatccagataacagataaaccatatgagttcacccgtgaattatctccttctcctgctttttgcaggtttcctgataacgagctgttgtggagcagccggaaatatttccgggaccgaaaaacctgtgtatatcgttgggatagatgcatactatcccccgtttacctatctggatgcaaatggaacacctgtcgggtttgatgtcgattcagttcaatggattgcggataccatgaattttaaggtacagataaccccggtcccatgggatgatattctcactgctcttgaaaccggagagatagatctgatctattcagggtttgctataaccaatgagcgaaaggagatctgtgattttacggttccgtactggcaagtcaaccagtctgtagcggtaaacaatcagagctccgtaaagattgatgacttttactcaggattacttcgggtcggtgctcagaacaatacccggggagttagctgggtggaattgaatctcatcggaaaggggaagatggcacctaggtcacttgtcaggtacgagggaatgaatgaagcattcgatgagttgcaggccggtcggctcgacgcgataattggtgcaagttctttaataaaggccaatctggatagttgtgactgccatgtgatcggcgagattgagacagatgatcactatggcgttgcagtgaaaaatggcaattccgatcttctcgaaaccatgaacacgggaatagatctcctgatgctctcacctgaatgggagagactgaaattgagatatctgatggagtaatccatcgaataatttcttgatcgaaaagggaagtccggctcggatttgggccgtatgttcactctcattatgcacgattattgtttcctgatattctctcaatctcgacaggaatacctggacagatgatatatgttctcccttctttccctgttccgattccctttctcctgaatacatccagaatattttgtccatgatggttttttcaccatcctcatcattggtatcggtggatgtactggtagttacggaggatagtatatcaacgagtaccgaaacctcttttttctcttctcatcccggacaaatcaattcttatgttcacatgataatatcagttgtatggaccatggtctgatgagaggattattctgcttatttctactggtatcactggcaggattctgtattgctgatgaggcacctggctattcagtctatattcagggtggagaatcgtccatgaccgaagatgcagatggattgatgctggttacgattcaggatgttgttccgtatatttgtttagaatttgaaaaaggagatcggttactcccaatcagtgatattaccatctttcagttcccattgaatgcagcacttgtcttttccggaacagacggtgattctgtctctcttatccagatctcaaatctttccctatctgatgataacaaagacctgacattgcagataaatcccctcgaattttatgaaggagagatgctgaaaggatatgcacatgatgccattgccatagaaaagatcagcacagaaacgcacaaatccataggtgtttatatggaggttcccgctcaaacgccctcaaatattcgtgtagggtgctattacgaatcaaattgtatctataaatgtgttgggtatattggttactattgttgattattgcgaggaacaggaaaagcacgtgggatctgaattttcatctcatggacaacgaactgttgggtggctgagcagagtattcgcaattcaatccacagttctcctctcctccttctgatgccggtacggtaggaggttactgatttcattctatttctattgttttcagaacaaaatattctcctattctgtcttttgataacaatttttagaaatctcccaaatactacgaacccactggcatacatgtcgccagagcctggaggtgagattttctgctcataaaaagggaggatacgtgcctttaaactgataatactttcaaattatacgcaaattcttgaaatattgtttaaatttaatttttctggctactacgctctgaatcacggggaggagttttctgtcatcaggacctatagatatatacgatgaggttcttcaataccgccggaccggtgaactgtgagaaacattactgtctcccccctcttacccggtttgatctgcctgaaatactcacgctcatcagtcaggagaagtactttgtcttgcatgcaccccggcagagcgggaagacctcatgtatgcttgcccttcgggactatctgaaccgtgaaggcaggtatgctgcactctatatgaatgtagaaaccgcccagaccgccagaagtgatgtttcgagaggtattaaagcaataataagcgaatttgcctttcaggcagacctgactattccggattcatcacttcgggataagataaatcattatattgaggtttatggtcctgatgcagcatttaaaatggtcctatctgatgtatgtaggagtgtatctcttccagtagccctctgtatagatgagattgatgcccttgtgggagataccctgatctctgttctccgtcaacttcgatcagggtattctgaacgacctgcacatttcccttcctcaatcatcctctgtggagtccgtgatgtccgtgactaccggattcattcggataaagacaaggcgattatcaccggtggaagtgcatttaacatcaaggcagaatccttatggctcggaaattttaccgaagaagagactgggatccttctccttgaacacacgaaagagacaggacaggtttttgaagaaggagctcttgccgctgtctggaatctgacacgtggccagccctggcttgtcaatgcccttgcatatgaggtctgtttcaaaatagaagagggaaggaaccgttccaatccgatatcagagtctcttgtcatagaggcaaaagagcggcttatccagagaagggagacgcatcttgaccagctggtggataaacttcaggaagagcgagtcaggagagttatcgaaccaatactcaccggagagatgtttgaaaagaacttcagaccggacgatatctcgtatctcgtcgatcttggtctcattatccaggaacaaggtggagctcttgcgattgcaaatccgatataccaggagattattccccgagaactcagttatactgcacagtcaggtatggccctgaaatctgtctggtatatcggtgaagacggaagaatccgggtgaatgatctccttctatcattccaacaattctttcgtgaacactccgaaagctggaccgatatcgcccagtataaagaggcagctccccagctcctcctccaggcatttttacagcggataatcaacggaggcggacagataatacgggaatatggtctcggacggggaagaaccgatctctttatcctctggcaccttcctgacggaacgtatcagcggtttgtgatagaatgcaagatggtgtacggctcacgggaggtgaccatcagtaaagggcttgttcaggtgacaaaatatgctgatcgatgcggggcagaagaggtgtatctgcttatctttgaccgggataaaaacaagagttgggatgagaagatctttacagtaacaattgagcatcaggggagaatggtagcagtatttgggatgtgagcagggatgaaactttttcagtctgagagataatcaatggtgatttcgtaaaacattgcaagaaagatatttattctgatctcaaggacctcattgtcaaatagcagcaccatgcacaatccaaatagatgaaatcgtcatatattcggcgatttttttatattttcagcgaaattggctttttcataattgtttgctcgtttcacggagagggattttctatcatcaggatcaatagagatacgatgaggttcttcaataccgccggaccggtgaactgccaggatcattactgtctgcctcctcttacccggtttgatctccctgaaattctcaccctcctaagccagaagaagtattttgttctccatgctccacggcagagcgggaagacctcatgtctgcttgccttgcgggagtatctcaataattcaggtgagtatcgttcattatatatcaatgttgaaacggctcaggctgctcgggatgatgtagaaaacggggtccgttcaattattgttgaaattaataaaagaatggatcaaagcccggtttttacaggattgggtgtggttactgcagatttatgggataataccaatgcctactcagttcttaatattgtcctgagcagacttgcgtcaattgacaataaacctctggtactcctcattgatgagatcgatgctcttgtaggtgatacattaatttcagtgctcagacagattcggtcaggatatgatagtcggccggttcatttcccttcctcaatcatcctctgtggagtccgtgatgtccgtgactaccggattcattcggataaagacaaggcgattatcaccggtggaagtgcatttaacatcaaggctgaatccttacggctcggaaattttaccgaagaagagactgggatccttctccttgaacacacgaaagagacaggacaggtttttgaagaaggagctcttgccgctgtctggaatctgacacgtggccagccctggcttgtcaatgcccttgcatatgaggtctgtttcaaaatagaagagggaaggaaccgttccaatccgatatcagagtctcttgtcataaaggcaaaagagcggcttatccaaagaagggagacgcatcttgaccagctggtggataaacttcaggaagagcgagtcaggagagttatcgaaccaatactcaccggagagatgtttgaaaagaacttcagaccggacgatatctcgtatctcgtcgatcttggtctcattatccaggaacaaggtggagctcttgcgattgcaaatccgatataccaggagattattccccgagaactcagttatactgcacagtcaggtatggccctgaaatctgtctggtatatcggtgaagacggaagaatccgggtgaatgatctccttctatcattccaacaattctttcgtgaacactccgaaagctggaccgatatcgcccagtataaagaggcagctccccagctcctcctccaggcatttttacagcggataatcaacggaggcggacagataatacgggaatatggtctcggacggggaagaaccgatctctttatcctctggcaccttcctgacggaacgtatcagcggtttgtgatagaatgcaagatggtgcacggctcacgggaggtgaccatcagtaaagggcttgttcaggtgacaaaatatgctgatcggtgcggggcagaagaggtgtatctgcttatctttgaccgggataaaaacaagagttgggatgagaagatctttacagaaacaattgagcatcaggggagaatggtagcagtatttgggatgtgagccaggaacggctcctgattctgtgccgaattatatctctcccagatactctctcaatgattgtatcatggatttatagcagtcaaaagatggtaagccggtattatctcgtcatgcctgtcatgatacactgttctatgagcttgatgagtgtttgaaatcatccgtaccgatacgaaatttctgttccatgcagccccggtattcttataataacttttttctctgtgagcatgtctcttttcatataatcaaaccaggatgagatatgttccaggattacgccatattatggaaatgagattatgcaaggatgatgaaatacaccatttacaagcaaccatccccaagtcatctgtccagggatcctatggggggtggtcacagtgccattcggcgaaaagacgttccaatccggccacacgttctccagtcggacagaccagtacatgaacggagcctcggtcttggcccctgacttccatacgagatccccaatgggcggagtggtcattctggcagaagagaatcaaacgtatgggctgtcaggattgcttgtaatagaggcggtatatatcgacaatcatcagagcattctgttccatgaatacatacatgaaccccgacagggtctcttcacctacgggtgtgatgatgtgccctccctgatcccagggtgtgcataaaataatgcacaggtacatcaggcgttttttaaaattaaagagataatagagtgttaaaaagagtgatcaagtacggtgtgcataatttttattttcacatatgcactcacagatccatcatctgcctgttacgtgatctccctggattatgcacaccgtacaaaccctgtgaataaaagggtttgattattgaaaataacccctggtgaggttttcaggtgttcctttttccggcgaacacctcgtgcacacataggcacacctgcacaccgtcatggattgttccaatttcagtggagattttctcgatgaatatattggccctccccatatatcctttttttgaagatattcaaaaggaccccacatgaatctctgatactgtggtggtattctaccagctctggtgatacaatctctgtgaggtcccgtccatatatccgaacagaccaaagtcaggtgacctgaaggtcccaatcatctccgtattgatcttggtcgtctcccgtgccacgtcgatatggttttgaaggaggatcaggactcccacccccgatgccacaggtgatccggcaaggatgactacatccacaaataatccatacatagaactacattcacatacattcaaatacacccttcaatcaacactatatacagaacatccccatgcctccccggaaaaatcctgaatccgctgccagatataccgaagcgaaaaagacaccatacattcttgaactagcaaaggaacgtgaattcagaaagaacttcgaacttgagaaggggaaatttttcagaactgacaccgttgcagagattctggacatcgaacctgaagttatccgggatttaatcaggaaaggagaactctttgcgataaaaatagggaagtcataccgggtaacagaagcagaccttcaggagtttctttttcaaagatacaccaggaaaagaagcggagaacagagacgcgaagaagggtaggcctattcccggtctgaccagaaccgatcccgctcctcctgttccttcttttttcgcttcctcttttgctcctcttcctcgttcagatgtaacccaagtgactgatgaagccagtatccgaatatatccatacacatcaccaatacccatccatatacccgaccggagttttcaggggtcttcctggcacccggggttgtgctggcatctcttcttcctcttcaggaaatgcccgcttcccaaacctgacgatgatctgttcatactcttcatgggcatcgtcatcatcaagggcagcgagggcatcgcagagatttctccgtgcaataacctctccgggctgacacctgattgcctgcctgaaatcagataccgccccctcgaaatcacgcagaccaagtcttgacaggccacggttattccaggctccccattcataaggcatgagtataacagcctgattcccatgcacaacagcctcttcatgccgccccaggttggataaacaccagcagagtgcagaatgggcaacaccggatgagggatccagttcaagggctcgaaggagaaccggctctgcctcatcaaaccgacggagattatctagaaccaggcccttctcagcaagaaaaacagggttgtcaggatcgttttggagaagttggtcatataccgcaatcgcctgtacatatcgttcttcgttctcttccagatcgccaagcatgtgatatgcatctgcctggtaccgagagactatcggagaatctgactctatattggtgagcgtcgtacagacatttacagcaagcctgaccaccccatatcgtttcagactgaccgcccgttcatggagcagttctgcgtacctctccggagtatggcttatcgttttcagatcctcgagaggaccctgcaatcggagcatcttcagcccttcctccagtaggtccttcacctctccatcgtatccataccggccggctgcaagagagagctgggaaagcgcctccccatactgttccagttcaaataacactctggcaaaggtaatccgcagcgatgaatcatcaggatcctggcgaatctcctctgcaagcatcctggcggcctgccggtaatccccgataaatgcccgaagctctcctttctcagcctggaagaaccgggcagcatactccgaaaccgattcacactccttatcgctccctgagagaatccgggctgctgtatgcagatacctgacctctgccgtgtttggaagggaattcttacattcagagaagagaatcgcggcttcttgtgcttccgtagccaggagtaataaccgaccatacatcaggaggtttttcttcgaagagccgcatattcggaagttctcccgcatcgcataaagaccggtacgaaaactcccctcaagctgacaagccagggcacacaggtaataatccatcggacgtccgggattcatctgcatgatccggacagcagtaagggctgcatcgcgatattcaccagacctgataaggcagcggataaacacttcaagcagagtgcagtcagatgacaacgcatcctttcgtgaactcagttcaaaatatgcatcacggtatcgttcctgttcaagaagcgtcctgacatacatattcagtgcgggccgggaatcaggactcttcgtgagaacatcctgtgtgattatctcagcatcatgcaggcaaccgaccgacctgaatgcaatggcacggatcagacagaaatcctgctcttccgaatctgcaaaccgttcggatatgagaacggcatctgtcccccggttcgccataatgtaacagaaacagagaaaaaccagatactccggagccccgcttgcatgagcaaggacctcaaagggtggtattgcagcatccatgccatcggtcatgaataattcaagggccagagactccggtgtctcttctgacgggggcttgaaataaccggcagatttcatgtgaagcagggaaaacatcatattcgtccgatccctcgctgctgcggttatcagaaccctgatggcctccctgatcttgcctgatgaatacagggccgatgctttcagatatatcgctttccatgcatcgctcgccttttcacccgtctctgccagtctgatcagatcatcataccggccggtgaaatataacgatgaaaggtagggaatgaagagatccatgtcgtccggagatgatttttgtgcagattcgagaaaaacttcagcttcttcatatctgcctgatttcaggagctcttcagccctgaacacgggagcggcctctgggtggggcggtgcataaaagccagagatatcccgcctgatcacaagagcctcatcctctcttccacattcggtcaggagatgagcaagatcaacttttgactgcatatcctggggctggtcctcgcatgaagcccgaagaaaggtctctgcagcactgatatcaccagatctccatgctaatatcccttttacataggggaccaggggcattttatctccctcctctccaacggcggccatgatctccgcggcagcagacatctcccccgtatgaataagagcgagagctttgagtgcatgaattgtcgccataaatccggtgacatcaggggtgtcacccagctgggattgtatcccgtcacaatattcaatggccagatccgggtttccggtgaatatatggcagatactgatgaagagttttcgaattccggcaagaccattggacataaattcatagtgctgaagaacagagagagcactatgatagtacccctggagcatgagatttctgcccagctcatccctgaacttctcttcaaagggattctcccggtagatctgatataattgccttaatgcctcatccggacgtttcaggtacgaaagaacgatagatttcaggaagaggaggtacagattacccttccagacagacagccccatgtcaacctgagtaagggcctggtcatattcctccgcatcaaggagagcagtaacccgggtgatcagaaaatcaaaccaactgcgtccttcctgttcaggtatatcttccatcttccttcctccgtgtagtattcttcgacgttataaattatatatattcgcatacaaaattatgcaaaaatatacataattatacacaagccaatgatttcgatctcatcgcctggataaaccaggacaggtcgtcagacaaccgggtctgggtatggatctctttttaaaatgcttcagggagatatagagatttcctatacaatttgaatgaatttatagggatatggatgggttgaaaagacaggggattcgtcctctgatcagtcaggaggaacataaaccagttcatctcctttacactgtacctcaccgcgatccatgagaagggcaataccctgttctatcctggtctcaagtgcatgatttatccgttttattccaaacagggaaccgactatgcgggttaacgcactggtgctcatcgatcccgtctgtttcatcagatggatgatcgcgttggaatactcatacattgatatctcatccgcttttcgttgccagggatctcctgccgggtgggagcggaaggtcacatattcaagaaatgcctgatgattggaccagaaaaagatctggtttccttctgtctcccggtggaagggaagcgataggagaagagattctattttattctttaccgatgcggttttccttgtgatctgccagtgggggagaagacgtgcaatacagatgtcacgggggacaggaccttctattgccacaatctcttgtaaaacccggataatgtcttcgtcacgggttccactcaggagatcatcctttgttcccaggacctcatatcccacatacgccacataacagatctcgggaaatttcaccggcacggatgggatatggtgtggcagggatgatctttcgaacgattttacagcggattttggagatccctcatcgccggagataccatgttcgtcaccatcatcctgtaggatctcatgttctccctgatcgccttcctcacatttctcctccagttcctcgccctcaaccggacaatagagcattgtttccggtgcatactcacttctgatcttttcaatggtgtggatgatgcgatgcagctcaacctcctgctcatcccaccagtcggtagaccacaaccggtgaatattccagccaagggtatgcaggacaaagaaggtgagaacgtcgcggtcacgggctgattttgccttctggtaccgtggcccgtcacatacaataccaagaatataccgtccaggcaggtcagggtccagtactgcaacatcgatccggtaccctccgcatccaacatgagtatggacctcatacccctgatctgtaagggatttcgctacatccgacacaatgggcaggagatccgtctccatatcccggatacaggtctctgcaatcgctttcggccctttttccgcgaactcaaggaatgatttcaggaggacaactcccatccgcctggtccgggacagatcgatctgctccggagtcatcgaagagaatactttaatctctttccgtgccctggtaattgccacattcagccgtctttctcccccgtcacggttcagcggcccgaagttaagggaaaccctgcccgatttatcaggaccatatccaacagagaagagaatgacatcccgttcatcaccctgaacattctcaaggtttttgataaagaccgaatcaggacggtcatcactgaaataaggttctatatcaggcctcatccgccgttccttctccagaagggtccggatgagatcctgctgccgttcgttaaacgtgatcaccccgatagagtctgaggacgtggcaggatcgcaaagccgccgtactatctcgctaaccactgcttcagcctctgcccggtttgtccgggtatttcctgagtcaaagaccccatcaatatggacaagcgagatggccgggctggtatggggcgagggaaatgtcaggagacgattacggtaaaagtggtagttgctaaaggcgataagactctcatgcctgctccggtaatgccatgcaaggtgcaactgtgggatatctgatgcaatgcattcatccaggatactctcaagatcaagagcagatgtcctgaaatcatctccatcactttcattcatccgctgaaagaggctggtcggaggaagctgttttggatcaccaacaataatggcagaatttccccgtgcgatcaccccaatcgcatctgacaccgggatctgcgacgcctcgtcaaagatgaccaggtcaaaccggtggatatcagggtcaaggtactgggcaaccgagatcggactcatcagcaaacagggctttaatcgcggaagaattgtgggaatactcttaaaaagactcctgaccggcatgttacggcgctgcaggtgaatctgatgacgcagaacccctaattcctccttctctgccccttcaccccttgggatccgtgccgacagtctggcctctatctcctttctggtcaggtcggtgaacctctcatcaatctccctgaatttttcgatggaatcctcaaacttcgggcggtaaaattccttcagtaccggatcctgttcacgaatgccatctacccagttctggtaatagctccggagcatcagatcctcaatctgggaatggataagcgttgcatcctcataccgttggatgaccggtgaataccccttctcatccgctacctgtctgatccggttccactgacaccagctcttcaggtgtgatgtctccttctcccatcgctgaactgttgcagcctgggcactgagaagatcggtcaccgtttgctgcggccagagtatcccgggatcatactgcagcagatcggcaagggatgatccttcacggtcatactggtgtaatgcatcctcataatcagagaactgctgccgaatctgcctggcatctgactcattcataaaccggaacgtcagatcactccagcaggtgacaagccggatatacccatcctcatctgccctgattcgggatgcagcagccgaaactgcctctgctgaccgtactaggttctcacagatatcaaagtcctgatcctccacattccagtaccggccaaagaacagggcggcacgatcagagaaattccggatgatgttatccagttcctgcatccggtggatcttcgggatgtcatgagagaattcttcaaccggtggaatggacatgagacaatacggcaggatatctgattgtatctccctgaccagtgctttccgccgcagaaaccaggctgatctcatgctctcaatctttttggagagagaggtgcagtcaagctgggagatatctggatgataccgtcctgccagataattccatatcctgttccgctcctttccggcctgaatgaaaccgcctatctctttacgggtatgggggtcccgaagagcacgaagcagatcaggggagagggcacatccagctgtgctgagtagccggtatatcgggataatctcgttgagaaatgacgagggagatgccggatcaattcccagaatatcacacagaattggaaagagggaagaaagtttctcaatagaggatctgaaatgtccaagccccgtctccactgccgtcttccatctggcactccactccgtgcagtggacacctgcccagacattatcccgtggatggacgatctgcccggtgatgatccggctgtcatggataaatgcctggatatcctgaagcgtttccctcgtacaatcagatgcatccggccatgaaaggggtatatactctacatttcgaagacgaataagacgctcgagcccctggtagaaactctccccggtgctcctgaccgaatgaagggcgtggacataggagttcagcccggcccgaaggtcggcaagatattcggcatacaatgaccagtcatcaggagcaggtaattcatccaaggaaaggacctcttcaaactggcgtaatacctcccgtttatggctcttgttcgagtgaagttcaaggcagaatggtgcaaggccggactctttcagccggctgtgaacaacatcaagggctacccttttttctgacacaaataataccgtcttcccaagagccagacagtgggcgatgatattagtgatggtctgcgacttgccggtccccggtggtccatggaggacaaaggtcttcccttccccggcagcaatgactgcagcaagctgtgacgaatcaacaccaaccgggcagaacgcatctcccggctgcacagccaaatcaagggttgccggctttcgaaatgatccatccttcgggtacggaaagaggtggggttccacgagattactcaccaggggattctccatgaaggcttcagcataggtagagagatcccgccacatgagatacttaaggaaggtgaagtgaccgatgactgccgtgctcactacctcatatctgggcagattcttcacactcttcctgaactggtgcaggactgcggcaacatccaccccgtgctcatctatcggaagtggatcgatggaagatatctcaatctgaaaatcctgatacagtcgctctaacagggttgtgttgatccgtggttcgtcatctcccatccggatggaaaacccggtagtcacatcttttctggttatttcaaggggtatgagcaggatgggtgcatgaaggggtgtatcagagatgtctgtctcataccatatcagggtcccgagtgcaaggtagagggtttctgctccgctctcttccaaagacttcttcgcctgggcatagagattgtacagtcttttactcagttctttctctgatatctgacaatataatcgattcctgcccagttcctcgacaaaatacccaaacaggggatcatgcgggagcagggagtggggggtaacttctccggtatgatcaaagtgatgcacatgaaacgctctcccttcaaaaaccgcatccttcagccgtgtgagatccggagtcagaagcgtgagatgagaccccgaattatacatattcaacaggtggtttctaagcgtgagatcaaggagattatgcatccaccgttcgagccggggatagcaggatcgtctcttctcatatggaaagaaaggcaggggcgggtgaatatcgccaggaggagcagggatggaaccgctagatccatctccttcagagagattatccggctctgttctccggtcctgatcatccggtatcggggtttcatctgaaactgccagttcttctgcccacaccggaagaggaatgatattatatctcccatttcgtgaggtctttatatcaatagcacagaaaaaaccctgactgtcagagaggtgaccggctccactggtcacagacatctcaaaagatacaggggtatcagacgtcgccgtcaccacgtcaagaaggagaatttcaccaagttctacccgctttttgatgggcagagatgcttcaatgaccacatcactgaaggtgtcaggaatcagccagcatccggcaaaggcatggccctcagtgatacatatgaggggatgaagaccgattcgctcaagacatccggcatacagaagggagagatcaaggcagtttcccatccgttccccgattatcgtatctgcaagccttaccttctgcccttcctgttcaaacccggcttcaggtgtcgcatacctgatatgcagatcctggagtgcagcatagaccgccgctgccatcttcctgacccggttactgtcacgagtctgatacccggtcagtgaggagtccctggtccacctatacaggatatcctgtgctttttgtacgattgcagtaatttcaggactgttcgggatgataaacgcagatatgagttcaggaactgaccgaagaccactccattgatcataggcaagaatcctgaccgagtatgactgaatgagaagtggtttcccttggtacgagatctcagccgtgaatgaaccatgaaccggagaaacgaccgttctgaaaaatccatgacgaaggatgagagggatcgtatgaatggtaaaggtctccccaggtgatatctttgatatgatgatctcataaggatcagaaaaagagggatctgatgtgatgcaaagacgtaaggcatgtaagggagtatctgccaggttcccgacctttatccgcttgatgacaggaatccggttctgctgaaccgcatagctgattgccgaatcatactcaacgatgagagagagcggggatgacccatcaggtacactctgttgatctggcggaaatttttcagtattcaccatatcaccattctggtcatacgagaaggatcatgttcacatcggcatcgtggctgtcggtaccggcctttattgatctggtatgttgcgggtgtttatgctttcgaaaaaaccggataccataagaataaattcagatatcaggtaaaatgtattcccctgcacggggatttgtgtgtcaggtgggagaatgtggtgaacaggagttcatatgatggatggtaggttatgcaggggataatagtagtatccacaaagagatatatgaatatacgtgtatgaacatattgagcattatgagcaatgtgaacatttctgattcacgaggaaatacatgactccggccacagaaaaacttgagcaactggtccacatcattccaattgggtatgagatcgaccgggtgatcaccccgttccaggagataaaagcccaccgcgtccacctcatctcaatggatgacctgacaaagtatgataacccaaatgaacatgcactgacgtccaggcagcatggatttgatgagcggaaccgtgcgattctggagaaaaaggggatagaagtggaactgcaccggattgacatgtttgacatcattgaagtcatgaaaaccatctcatggcttattgtcaaagagaagaagatgggaaaccgcgtctatgtcaatatgtctgcctgtggaaagatcgcctgcgtcggggcgactcttgctgccatgatccataatgtcaggttatactatgtcagggccagccggtactcatcaacaaagaaagaacagaatgagcacggactgtcgatatgtgatgcggtaaaggtgtggcagctggagaatttcagatttgcactccctgatgaatcatcactcctcattcttaattatcttgcgaatagtgatgatgcactctcctgtgatgatctcatccggtacctccattcgatgcatgttgacgggtttgaagaggattattggaattatgcatatgaaaagaggagaaaagtgcagaccagatacctgatgaaactgcagaaccggtacttaagtaaactggacgatgcagggtacatcaaacgaaaaaagatcgggaggaatacggtagtgaaactgaccaagaccgggaggtatgttgcggctgtaagcgggatggatggagatactctgtaaatacgcccggaacggaaaggccgataagaagataattaattctcttcatctaaaaatttctgatgaaaaaatttcttctcctcatgagtctgtgtgtattcatgatggcaattcacggatcttcggtctgtttcgccgcagaaaccccaaggctggttgattattcattggatcgattcaacaaggctccggacctggtcaataccgaactggaccgtatgaataaatcaccggttctggtcgatacagcactggatcggtttaataagacatcaaatcaggtggatacagaacttgatcggttcaataaaactcctgatattgtggataccagacttgatcggctgaataaggctcctgtctttgtcaataccgaactggaccggtttaataagacaccgcaattgatagatacggaacttgatcggttaaacaaggcgatagaactcgtgaataccgaactggaccggtttaataagacaccgcaattgatagatacggaacttgatcggttaaacaaggcgatagaactcgtaaataccgaattggaccggtttaataagacccctcaattgatagatacggaacttgatcggttaaacaaggcaatggaacttgtggatatcgagctggaccggtttaataaaaaatttgatctggttgatactgaactggataggttcaataagacaccatactgaccatactattttttgtaacccgggttctccacccttttcttagttgaggtttattcatcttcagatgttcaggaggaatcaagagagccagattacctatcgcaatctcatttcccggttcaagtgccagcacccgcatcgacatctctcttgacttgtcgtttttctcaaggaaccggtataaagttccaaggttatttagaccaataacataatccgggttcagcgatacagcacgctctaaatccgttattgctgcctcaaatttttgctgctgcatatatgcaattccccggttcccaagtcttctaataaacgaacttctttccgaaatctgaacacatctgtttcaccgcttttctcccgctcaaaacagcccccggtattccaccgcccgtgacaacccactgaccggccatggaaaacccggagagaccagggaggatctgtggcagatccaggaagaaggagtcaggggtgacctgccagccctcataacttcccctccagttcccggtatacctgacaaaagtcatgggcgttgctacatccataacctcacatctttcagataagtcaggatactgctgacataaaagggctaatacctttcttccgacgtcatccttttctgccaggtaggcttcactgtggtactgcaaccggtcccagtacgagtaatctgcagtaatccatgtcgtaataaccccttttcctggtggatagagggtgggatcatggacatgattcctgaaactgatggtatcctgcttcactccggcaatctcaaccggattgtcaaacagtatggtcagatctttcgggatatgggagagatcagtactcagcccgaatgagatgaagacgatcggtggaaaaggtttcaggttctggtaatagcctcggatggtgtcatcacagtatgctccttgcagccactcaaagatcgtggtatgcccgtcagcacaggagatgacataatcagcataccgctcggtcccgtctgcaagtctgaccccctttgcccggtttttttcggtgatgattgcggttactttgctcttataccggatgaccccaccaaggtccaggtatctcttctcaattgcctttgcacatggcaaggaccccccgatcggatacccggcattttttgccccctgcatagcaagacccatgagcggaaagaacagagactgcccttcccacccaaaccctgcagtgagaagatttcgaagaacaggactcttcacttctgacagtatatcatgaacggttggtttgtaccgtttcatcaggctgaaataagggatatatcggatgatatcaaggatggtcatgtcaaccagtgtctccatcctgctgagttttttgatatccttgcagagccgggagatgaagggtgtatcttccggtgatatccggatcagctcgtcgtataacctatcaggatccgtgtagattgtaatctcgttcccatgctcatcacgcacggatgtccatgagtcagtatgatgaaaccttctgccctccatcagtccgagtttgtcatagacctggtacaggggtgtcccgggttttgagccgcagagccagtggatacagagatcaaaggtataccccttccgggtccacgcggtacacagcccaccggggattgtatgcatctcaaggatctcggtctcaaatccgttcatccgggcaaaacagccggcggagagccctgccattcctccaccgataatcagaactgacggagccatatggtatagggataggtgatgatggatgatattgactatgatagaccaaacaactcagttctttttgtattcacaggcctgatcgataaatgagcgaatgggaatggacaatcacccggtatacctgacctgataaattaccccgttcatatcatctgaaatcagcattgatccgtctggaaggatctcaacatcgaccggccttccatacatcttcccatcccttagccatccttcaataaagacagataggagatcgcaattcattacccggaatatccgctcacagatatgagagaacatacaccggtatcacacggagggataatcatcataccggttaccggtgactcatactttgggttttggaatatctgataggctatcagtgatcagatagaataattactcaaagcctctccaaaaaaaatccggggggattgtctttttcacccggttatacttttttccggtcaggcctgccaaaagagaacctgattacatctttgggacaggcatcaatacaggctccgcacaggatacattcagcctgttccatccggccctgttccaccatggagaggacatcaagcgactgggaacattcctttgtgcaccgtccacagctgatacaatcttctgaatgagcggtcagctgaaggccgggaagcccgatggcattccggatcttcctgccaacgatcatcaggacagatatgggacagaagagatggcacatccctcttctcccgaggaacagtgcgattgtagtgatgataaagaggataacaataaacacggtcagttctatagggccggctaccgagaggccattggttgtctgatagaatggctcaattgaagttatgcctcctgctcggatgaagaaggcaagcagcatgaggatccagaggacaaagagcccgtacctgaaccggtctatccaggggtttgttatccgcttttcctgtacctcacgagccagatcctgaagagagccaaaaggacagatccacccacaccataatcttccgccaatcagggaaaacaggaagataaaggtgaatataatagcactcccagttactattccagatacggctccttcaatgatgagaaccggtgagaggtaaaagaatgtgacggggaggaggaggagtgagattagaaggatcagacgtctgagcttttgctggttcatacaccacccaatctcatttttattgattcaggcatattactctaccacaatatatcgctggatataggtcgtatctgcatcggctggtggttcccaggatcggcggtatactccggtaaaggtctggttaccaggggcaatggcctcaagggtccacatatgcacccctccggctccgacaatctgcttattctccgggcctatgaaggagtcgttcacaatggcaagtccatcagatacggatacattccaggtgtatccggttgtcggattttcctttaacgtcacttcggtcatctctcctaccttcagctggatgggagactcattatcagttttgttctggagcatggctatctcctcttcaaaggaaagcggtatatcaggttcagattcggtgtctgtctctgataggccgggagtattctcaggcactacaggggtttcaaccggattgctggaagttccggtgcatccacagaaacataccgctccggtcagaagcaggatgatgaagatatacggattcatgtactacattcacgtcagggagagggaaaaatctgtcggtatcagggagagagaagaaacaggtaaaataagggggatgaccggtgcattagatatctgaagagagcacaacgtagcataaatatatgtcgatcataataggaattatttatcatggttcggtggcaatccattatgaatgaccgagagcatacacagcaggatagatcctgatatcctgcagactctccttgaccagaatcctgttgcaatggcccagtttgacacccagtttcattttgtatatgcaaaccaggcattttgtgatctctccggaatcgcttttgaaaagctgatcgggaccagaatttcagacctgaagatcgtaaaactggaaggggaaggatccaaagcggccatcgaagagaagcgaagaggaaaggcccggatagaggttgagtttccatccggatttaaaatactgaacgcctataccatcccggttctggacgcagagaaaaatgtcacatcagctctcggagtatatacggatattaccgctgaagagtgggaaaaactgaagacttcacagataattgagaataatcccatcccattcctgttattaaagaccgacctgggaattgaaggaaccaacacggcatttttaaaaatgaccgggtataccacggaccagttattaaggatgaaactccccgattttcagattctgaaactggagggaaaatctgcacgtgattgtattacttcaaaaaaagaggcaattagcgatgcattcattgattttccatcaggcaagaaatatatcaggctctattccatcccgcttcttgataagaagaacgaggtaaactcggttctcatcacctgtgtggacctgaccccccagagacggctggctgaatatcagcagacagaagttgaacgtcttgcacagaaccttcagaacctggcaaagggagatctgcactttgatctagccaccggtcagccggatgaatatacaaaagaggcccatgcacagtttgccaccattcaggagaacctgaaattagcaggagataacctgaccggagtaaccaaagagatggatcggctcatccaggcgataacggcaggaaacctgaaaatcatgggggaggcagacaaattcgccggcacatatcaggagatcataaatggcctgaacagggtcgtaaagacggttgatgttcaggtatctgcagcaataactctgtccggtgaatatgcaaagggaaatttctcggtaatccctccagatatcaaggcggaaggagactttcttatcttaaaggaagcactgatgaacatcggagtccaggtctctgccgtgctgaaagagatcgaccgggagatggaagaactcacgaccagggccgaagaagcaaacgccggggtgaaggatgttgcagaagggtctgccatggtggcaaagaatgccgcagaggttggcagccagagtgagcgggggaaacagaatatcgaccaggttctccgggccatgatggatctctcggcaaatgtggaggaggtggcatcaagcaccgaatcagtcagcaaagtcacccacgacaccgatgaactctcaaagaaaggggttgaacttgcgcataatgcagaaaacggcatgaaagggatcatggcatcctccggtgaggtggagcggatcatcaccgagatcaagggtgagatggcacaaattggaaagattgtgaatgttatcacggatattgccagccagaccaaccttcttgccctcaatgctgccattgaagcagcccgtgccggtgaagcaggacgggggtttgccgttgttgcaagtgaagtcaaagcccttgcacttgagtcacggcggtctgcagaaaatatcgccgagatgataaccagcctgcagaaaaagtctgatgaagcagcaaaggcaatggaccaggcagagaataccgtatcacaaggaaatgaggcggttcttgaaaccctcaatattttcaaccagatcgtagagtcggtcggacagattgccaggaacatggatgatgtgtcaaagaccaccgagcagcaggcggcgtctgttgaagagattaccgcaagtgctcatgaagtgaacagtctggtcggggagattgcaaccgaagcaatatccgcagcatctgcagcagagcagagctcagccgggaccagccagattgtcacggtggttgaggatctgaataaaataattattgaagtatccagggcaatcgggaagtttcagtatcgataattctaaaaatatttttagggtcagattaaactcatcgtggtctgttccatactcctaaatccactactggttgtcgtcattattgtgatgaccatctgaatcagtttcccgaaagaattataccaaaactcggttgtataatcatagccattcgttttggtgacaattatcccttcattatcatttcttgtaatactagttatgattcctgtatcaggatcctgatcaaaggtaccggtaccaaggccaaatgcttctggaggtatgaaaattcctccaatatgggccataccagatactgtggtagttgaactctgggatgtgaccatatcctgtgagactgtggacactacaagcgggacataccgatttgtcaccgatccaaaaatatacgaactgctacggggatactgcgcaggaggaccaatttgtccatccaccgagaaaaccttcgcacccgaataggagagacgaagtccatctgtcacccatgttggtattcttccgcccatccaggggacctgtatggtcctgatatttcgtaaagcaaatacagagtaactcccggactggcgctgatactgctcacccccatcctggaaccaggcattattcttaatatccagtttatgatagaggagcataccggtcttcagatcatatataatcgtcagaattcccccagctccatctgaagagaagtcaaacttaattgcttcatacgcagtccctccggttgaatagggtaaatgggtaactacaaacgtctgggttgacctgtctgctactgcagcaataacatcaggatttacccaaaacggaccacatccggcagggtacacactcccatgactgtgcaccaggtgcatggtatcatagggaggcttcggggcatatgagtctgtggtaaccgcgatggtatccccgcttatcccgacaacggtcagttgggtaatgccagctccggtcccggcattatcacttgacagagcaaatccgtattgattcacctctgccccgccataggagaccatggtattataggagaacctgactccttcagtaacccaggaaggggcaggagcagtcaatagttcaggaatgaagatcggaagaggattctccactcctgacaccagaagcggggatgccagtgagggagcagataccgcaatcgatacaaaaatggcgataaaaaccagacctctgaactttaccagatgaacacccatactatcagagtgggagcataaggcaaaaatattgcactctacttactcctgaaaatctccttctttcgagtaaggatctctatcgtatttgtaatggaaaacatggttgaaaacccaagcaacgttccaagtatgaccctgatattatttaagtcccgagtgataagccggttttccagagtcagcatcagatcactctccgaagcatcgacatcaaactgataaacggcaaggttatttccggttaccttaaaccgggtcggtttcgggaccgagtttatcagttcgtaattctttgggagctgcacctgaactatgtatttcgtcacctggcttacaccagggatctgctcatcccccatcgcatacaggggaatcacaatagagacctgggaaagggacgtctgacgaatccagcctggaacgaatacctcaaccccataatagtcatcaatagcatcaggctttacaacgagaaccccgccgttctcttttgcatggctcagattttcatagtgatcatatggtatccggatggtatcagtactctcagcaatcttatctggataggtaataccctctctttcaggcatctgtaaaaatgagatattttctgcattatccgggacgaccataaggcatctggactgatgatcatatccgccccattcggtgatgacaatacccatggtcttctgctcgataagaggatacagaccgataaaatactttgcattctcatttttttcggtaaaaactccaacataatcaagttcttccgggtagaaggaactcgtataggagagatacaggagtgaggatatcgtaaagaaaaaaacaaccagacccagtatcaatttcaacacagggtgttctttcatatatgaagggattttcataaggctgtccggtctttagtacatgatcttatgagagtttttttattgccttttgaatctgcacctcggttcccatcaggtacagacaatcaccctgacatatctcttctgcatcggagaggaaaaagaccacttctttacgccggtcacgtgcaagaatggatatcccggtcttttttcgaagggtacccacatcagcaggtctcgtgcaggtgacctgttttgcggcgatatggagagaatgaccgatgatgtgtagaatctgtgcatcatggtacagcatcatccgacagactgcctgggccaggatggtcgggacatataccacataatcagcaccggcttcatacatccgggggatgagttcaggtcgtaaacaccgtgaaaaaatacagacatcagggttcgcatgccgcaccataagcgtggtaaacaggttttcccggtcatcatgggtgactgccaggaaaaaccgggccttgccaatgagatcatccgcagatgcaagaacagagcggcttgtcccgatgatatcagccccgctttgaggattgctgtcaatactgatacaggaaataccaaatttttgaagatccctggtgatgacagagcccatatctccgaaaccggcaacaattgcgttgttctcatcccctgccctggccagaaaggcaccgctgataagcctgaataatcctgcacccggtcctatgaaaaagagcaccattgaccggtcaataatcatatctccaggaggagaaaggataatctcacctcttttgagaagataaatcagcctgaactgataatcctcttcaaaccggagtgaggagatggtccttccctcagcaatactgcctggtatcaccgggatacggacaaacctgcaacttccaaatgcagaggaggtttcatgcaggatctcctgcataagaggatttttctcaagggtatctggttctgttgcaagcagggcatgccgggcggtcagggtcccgacaatatccctggaatggaccaggatatctgcaccacagaggggtaatagctgatcagcctcatgaccggatgttattacaataatccgtgcatcggtcttcttcgagaggcccagaataacctcggcagatatccagtcctcaaggcagaagaggatataccggcattcagagactcgtgcactattccatgtcttctcttcatcaaaccggccatagatgacctgaaccagtctgggaagagaagcggtctccatgagggcttttgtcttatcctcctctatcagaacaatatcaacacccagacaatgaatatgctccagtacctcaagtatgaccggattatacccgaaaatgacaacatgaccggcacagggataggtcagcgaggcaggaggaaccgggtggactttgttctgaatgactggagtgatgaagagatttatcagcatcaggaacatcacaacaccggatatcatcatgacaaggacgaatatccagagataatcatgcgagaacgggagaagctctccatatccggtggttgtgacggtctcagccacaaaaataagggcctctaacggagtgatggaggtatcctcgtattggttatggatataataaaagagcatcgtccatacgagaatgattagtgagaagagaatgagcgaaaaaagaacctgcttttcatacgaagactggatatttcggagcaggcgccgtattgatcgaatcataatctgatcggattctgctttaaaaccatatatattcgcccatcaggaacgagggacagcaataactatacaatccggtgatccaatacaggagtgtgaattcatatattcctgcagcactgctgttcctgacactcatcctgatagtaaacggagcagaacacacgaactataatcctgagtcagatctcttccgcccggtctattcaacccacctgagcggggaggtatcacctgaccatcctatccaggttgacctggatatccgtgacagtaagacgggttttgtcagagtatacggatggggggagatggggactgaatggaatctgacggttggagagggctatgaaaactttttcgttcctgatctctttaccgaggttcagaccggatatccccggattttaaccctgaaaaatatcagcagcgaatacctgatcctcgatcctgggagatatccggtatatttttcttcggactcatctggaggaaaagcagaaattctcgtcatgtatgtctatcatgaacagatagacttgggaattattcagaatcagacccattcagtatttgaaacatatattccacccggccttgagcgggtgatatttatgactgagtcaagagatggaacaaaccttgatctctatgtccataaagggtcaagtcttccggactcatacgaggaatttacctataattcaaccgatgaatgccaggagtgctggtcacaggggatagagaattttatttcagagatgcttgttcttgacaatcctgaaccaggaccatatctcatggtcacaagagcaaccggaggcgatgactttttctatacttactggaccggtatcgaaaaaaagaggtaattcatcgatgatcattgtgagattatctctgcactgttcggaaaccgcagcacatccatgagataaatatcataattcatattgtaatcgtacgcccacaatgaaggtaaatatgacccataggggagccgatcccgttcaatcgcaagttcgccggttatcaggagaggatcgagagccgtatactgccatctggattcaccgcccagaaaccgttcgacgatcaccggggttattatatccccggttctgacggtgaggggaattctggagaacagatactctccggttgaggggttgatctcgtaggggaagagggcatactgtatcaagccatcctggctttgcatgatattgattgcagtttcacgggtctttgatccccttgtaatattcaaaaatccaaaatataactcagttccattgatatcagttccataataggtattgtaaaaatacgagcggttcccggtcccggtatcggtcaggtaaaaggttttatcatccggatttggaatatagatcccctgagcgtcaggatataccggatcagctttcatcccgaatgaatgcgtaaagtttgtgacgtcaggcatccagtcggtctttaccatcaccatctgaataccctggtcatcactcacctgaaacgtcccattcccacgagtagttatcacaggtttactcgagtcggtggatatatacgagacataatttttaataaatgagaaccaggttgaattatgtatactattgccagatgatgcagagatttcatctatatgcctgttccgtggagagattgttgaaatacctgttgatttgggtcgtgaaccatcattgcgctggtataataccacactggccatggtctgtttcacctggccgatgatatcagaggagtctttgacatgcatcccaagattatctgacagatccccaaggtcaaccgagacctcgatatcttttctgggatcatacccgaatctctgtgcattgtaaaaagaagttccaataccctcgtatactggtttttgatccatcttatcacgaagaaatgtgccaaggagagagagatcttcttccaaatccgggagactggtcatttgaataagggagagggtctttttcatcggttcatgttgtggattgtccatgtatgaatctatgaccagctttgcccattcttcaatcgttattgcggggttatcagagagggcctgtaacgggatctcataatcccatccatggcccggttcaacctcttctgaaaccaaaagcagatgcccgaatggagagactgtctgcatgacctctaaagaacccatcagacaggcatccataccgataaggtcccaggttattgcggaattttcaagtgcatcggtgatctcctgcatcgtcagctgatcccagttataattttcatcaaaacacagcccggcaagggatgcgccatgatcccagaagatgaagatgttccggtcagatgcagggagatcattcaggtattcaacgaatgttgtcagtccttttgtatctcccatattcatggaggtatctctgaatgcatagtgaccatttccgataacaccatcacgatagtcatcctgaagatcttctttgtctgcgatggtcataccggaccatcccatactccgtgcacccccaaatgcaatctgaagatcgatatgcctggaatcaccggaaagaccggatagtatctccttaatctctgcggaaccaagatgtgactctgattcaaggtcgctgccgaccatgtacattgcaatcctggtcgttggaacatctgccggggtcgcaatagaagcagaaagcagaatcagaagaagaagggaaattattggaaaaaaaccatgtgaaaagaggggcataacattcatcaatcaatatgtcattatactattatttcttccttttgagaacagatgaggtcagtgatccatgaaaaagatactgctactcgtaattgtcattctgttatccggccagggaatggcatcagaaaccatatctgacccggcaatacaggctcttgtagtcattccgtctgcgggttttgacgaagagtcatttcagacggtggttcgtgaactcacattatatgatatcgcctggactcttgcagcccctgatcctgtcagtcaattgatatctgatacagaagtacagtcacttgacagcatttctgacatgataaccaatgagacagcaatcattgtcatcgggggcagtgatatgagttctcttttcagctctgaaccgctcaaccggatattagaaaagggttcccaggcaggatcgatctgtgccgggatcgggaacgggactctggctctggcgaatgcagggatcctgaacggggtaaaggtatcggctcctgatgagaatagccgtgtatttctggaacaatcaggtgctatcccggatcaggcagaaggagtgattaccgataccatcatcacggcacagggacctgcatcagcacaaacctggacagatattattgtcagggagatcatcgcccgtgaaatcacaaataatctcggggttttatatcttggagaccaggagaatggaaaatcagtgtatgtcattcctgagcgtctccgatcagcggtcgtgtcagggatcagggagggtcaggtcagtgatacgtgggcaggtgagtcatttggcatcccggccctgaatacatcagttcaggttccggtacggggggactggatacttaccatctcaccggagaataatgtatgcctgctctatgaacagtttaccggggcaaccattccgtatgggtcggttgtttatatcgatccctccctgcttggggcaaaaagagacttttcaacaaacaaagttccaattgaggggatgatccaggatatcaccttcaaagatgtataccagaattcgaatgagtataatgagtctaacaggactcttaggaactggacgattgaagtgaataacacgaacagcagtgtgaaaaagtcagttgccctcctctttgatgacatcagaattgcagagatcacctgggaagatcttacccttcgaacctgtattgaggggaacggcgtaggaagcgggattctggatatcctcaaaacacagggtgacggtgattcaagtatagcctacgatgaggagaagattgaagggtcgggctgttatgaagtggttattagtgtggatgccccaaaagggatcacggcatatcttaccctctttggtaaggagggggatatactgagagagaaagagatcgttattccctgatcagcagggcagatccaatctctttctctgtccctccgcacggttaccgtgcatatctgttgcaaccaggaaataatcgtacgaaccgcaggccacagcctcataactggtgacgacgtcctcattgagttcaaacggatgggaggctaccggcttccaggttctttctccgtttttagactgaaccactgcatatgggatgagaccaatacctgccatatcagatatggaattcagcctgcctgaacgggcgactttcaggatattttcctcatcaggtccaagatatagaaagaacatggttgtccgaccagtggtactctcgaagtagatgtctatacagatccatgactcatcaggatcatcctcttttgagatccgggaaaatgcataatactcctcagtctgattatcaactcttcgctggaagaaaaccggcataatctgaatcttcccggtctttggatccttcagatgaaatgccctcccgtcccactcagggagaacatactcaccggatggataagcgtatgccggttctgcaccaagaaggacatcaccatcagcattatgacggacaaattctatctggacggtggcatatccatcatccctgaccagaatcccattttctgaattggtcaataccggccgttctttgtcagagaggacagatctgaagaactgtatcaggaatgagtaccattcttcggatatcgctatgaccggtgagtattcaaagatatgttcaaggattatttccttgtgaaccggtgagaagattgagagaccatgtgcatacggtcgtttctgctcggtgtgatagagaactgcatcggatactgactggataagcgaatctgaagcaggatgcatggcagggagtgcattcccgatatttttggcaaatgagatgatatccagcgtatatgatatgaagatccgctcatctgtcttcaggctcatatacatctgaagtccaaattccccggaattggtaaggatctcttcgatgatccgctttccttcaggatctttgtataccgtttgtaatgaacgggagaaatcatccagtgaactgataaccgctggaatggcatctatatcaatcaaggagagcgttgcagggctgtttggtacctggtatctgatataaccatcaatgatatggataccaagttcttttggatcaattgatggattgttcaccagctcatgggcaatcatagagtaattccatccacgtgagggctccgtctcttcagatgcgaggagataccgggtcgtgcctgacaacgcatctgcaacctctatggtccccatcaggcaggtatcaagaccgatcagatcaaaatggattccggatctggcaagagcgtctttcagatcaggaagcgggatattcccggtatcataattttcatcaggaaatgctcccttgtatgccgctccatgaccgctcatgatcaggtatgttcgttcggcatttctccacggctcaaggagggataaaaactcctgaaatgattcctttgtgcccatattgtaatcaggatatgaacgggtatacgtatcccaggagtcataccggccattatcctgaaaatcagacgttgcatcggcaagagaatatacccgcataccacgccatccctccttatcagctccgccatatgcgatgatgacggtgagatttgggtttcctgaaccatacccctcccgcatatcaagaaggttctgggtgataaacccataatctccaagacgattttgagactcaatatcatttccgaccagataaaaggcaagaagtgttccatgatactcatatgagggttcctcaatatcagataccaccgggaatccaaccatggataaccccagagctatgaggaggcagtataaaagatgcgggtaactggatttactcataattcagatccatcagagatattggtcagacgctgccggatttcagaatcatttggattcagactgagtgcctgctcatatgcatgatgtgcttcagttctccggttcaaatcttccaggagtcgtcccttctccttccagagcaggaatgaagagggatttgcaatcaggcccgttgtaatcaccacaagtgcgtcatccccttttcctgatctttcatacagatcagatattacgagatacgcctcgataaaccccgggtcaatggataccgtatgattcagactggataaggccccggtttcatcgccaagcatgaacaggctttttccctcccagtaatgagccgacggtaaatcaggacgtaatgaaagactctgctgacaggcatcacgggcatcctcatacgaacctgtcccatagagtgctgctccatatccggcccaggcaagagcatcggtagtattcagctcgagtgccttctcataactggcaaccgcatccggatatttttgaagggatgtctggattgttccctgcagaagatacccctgccattcatccggatggcgaaacaggaactcttctaaagatatgagggcctgctcttgttctcctgcacctgattgtgcacgggcaagacccagccagccgggagatgaatccggatcggcctggagaacctgatcaaatgctctggtggcctcggaaaatgatccatttaaaaggaaacgttccccttcggcaagaaggtcatctgccgttccatcacttctggagtaccctgtagtcagggtattgagaactccggtaaaaagacccttgtctatgctctccggtggtgacgagttatcgcaaagggcagagggaataatcaccaggagaagcccgcaccaaacaagcattattgctctcatcagcagagtatgtaatccaggcatatgccaccaatgaggaatcggagttataccggataaaaatttctaaaaaagggtaaattattcctgggtacatgtcggaacaggagagacctccggatataccgagccactgctgctctgtcctgatgactctttcagttttgacaggaaggagatataatccccgttatcgggtgccaggtccacggctttttgtgctgctgcaattgcatcctgaataggggccccgctatcatagagtagtttagccttgagataataatcaccggccaggtactgcggatcatcatgagcaatgacgaagtcaatggattgtagagcatcggaatatctcttcagatactcctctatctgtgcctttaatgtgtaaagtattgccaactgagaattattggcagaacctgttgctgatgataccgcgtattttacctgttccagggcctcttcttcacgaccatcatacccgtaaaagagaaccttagcatagccatacagcgcaacaaaatctgaaggatctaattgcagtgcggtcttgaaattctgttcagcctgcttatactgcttttttgtcagatagtcgagtccgtcattaatcaattgatttatatctccccctgaacttaccgggactgttatcggcgtctggtatggctgaactgttggcatcattgtcggtgccatggtatagccgggcatcattccctgagtcggcatcggtgttggctggggatactgctggtactgagggtaggaggaatagggattatatccggtatattgtgggaactgatcggcgttctcatacggaagctgatatccagttgacccgtcccagccatacgagtagggataccaggcatactcactctcatcattcattggcatgccaaagacgtcatacaccatacccgggtaataggagtatccggggtagtatttttcttcagtatcacgctcaatgaaccggaaagactcaatcattggatcaatcaggattttttccgcttcaaactgatctgcgcggttatcatagttcacggagaatgatctgccgtcttttacggttgtaatcgtgtatgttctgaccggggtatcattcctgacccactggtaatcaaggaagaaggcatcattatctccaaggacccctgccccgcttgataccaccgttccttcagggaggagagagactgaagaaaccaggtcagacgtcaggtcttccagctgctggtcagttgttcttaccacgatggtaatcatcgtgacattattcggagtctgaaccgctaattccctcgtatctgcatctgcagcatacaccagggaggcaccctccggataggcaaaggaaaacccggcggttgtatcgttataggtgagatacgagacctcttcggcggtacagataccagacatcatcactagcacaagcagagtgatggtgatcgaatagacatgagaaagagatcccatattccaatataaccagagtgtactttaaggtatttgcatcagtctgacatgtggatgacaccatacgatactggaccgaaagagttcttcaaatcatctatgtatgaagaaaccgggtgaattccataccctgtccaataaactctaatccttttccgtccaactttttttgaatggtttttcgagtaatgatcttaatcaggtattatccggagatacctgaatgaagatcctccatacctcggactggcacctcgggaaccagatctgcgggcgtaaacgatacgatgaacacgaacaattcctctcatggctcttatccctcattaaccgggaaggggttgatatcctcatcgttgcaggagatatatttgatacaaccaccccgccgaaccgttccctggagcaatattaccagttccttgcaagagctgccggatcctcctgcaggcagatcatcattaccgccggaaaccatgactccccctcccttattgcagcaccacgggagctctgcaaatacctgaatatcaccgtcgtcggtcaggtgccggatgatcctgaggaacttatcaccatattgaaagaccaggacgggagacccgaacttatcatctgtccggtcccgtacctccgtgaccgggatgtcagaaccatgcaggcaggggagagtgccggagagaaggcggcaaaccttattgaagggataaaagcccgatatcatgcaattggttcctgtgcagaaaagatgcgggaggagatgggagatttcatcccgattattgcaaccggacatctgtttgctgcaggaggcataaccagggaagatgacggctgtcgtgacctgtacctgggaacactcgccagtgtcggggctgatgcgtttccttcctgcatcgattacctggcgctcggtcacctgcaccttccccagagagtatgtgggaatgaccggatgcgatacagtggtgcacccctgcctatgggatttggagaggccgggcagacgaaatcggtcctcatgcttgatgtgcaggattcacgcaatatgtcggtgaaagagatcccggtcccggtatttcaacaattacgcagaatatcaggagcgtttgaagaggtattaaaggaacttggcagattgaagatggagtactctcctgccctggttgaggtaattcttgaagatccccgtatcattccagacgcgtcggagaggatccgaaccactattcagggatcacctgttgaggtcctgaaagtgaaagctcagcggatatctgcacaggcaatgcaacctgaacgtgctgaagagtccctggccgggctttctcctgaagaggtatttcacagacggcttgatgctgcagaaatcccgaaggaagaacgtcaggaacttcttgaatcattccatgaaatctactcagaactgctggaagaggacaccaattcggagtgacgagatgaagatcctgcaactgaaattttcaaacctgaattcccttgccggtgactggaccatcgacttttccaatcccgcatttacctcttccggtatttttctgatcacaggcccgaccggatcagggaaaacgaccgttcttgatgccatctgtctggcactgtacgggaaaacaccccggcttgggaaagttaccaaaacgaacaatcatatcatgaccaggcataccggtgaatgttctgccgaagtcgtatttgaatctcaaaaagggagatttgtctgtcactggaaccagcggcgggcaaaaaataagccggacggtgagctgcagcccccgcagcatgagatcagccgggctgataccaaagagatactggcttcaaagataaaccaggtccaggagattgtgaaagaagtaaccggcatggactatgaccagtttacgagatccatccttcttgcccaagggggatttgccgcttttcttcaggccggggcagatgaacgggcaccaatccttgagcagataaccggaacagccatctattcaaagttatcagaaaagacttatgagcgatacacgagtgagcgggaaaaacttgagcaggtaacccgtgaatgtgatctcatatctatcctttctcctgaagaaaaggagagcatagagcagcagatagaggaactccggaaggctgcagcagggaaagatgttatgatcatccggaccaatgaggccatccagtggattgaaacacttgagaaactccgcagtgaaatcgatggtcttgagacggatgcaaaacaccttgacgagaaaaaggctgccttcgagccttccagaatagcacttcttgcagcacagaaagcggcatcattccaggggttatatgccccgcttgagttgaaacgggagacacttcaaaaggataccagacagtatgaagaaacagcccgtatgagagactcactcaaggcttcgcttcccgacgttgagagtctggttctgagtgctaaaaccgaaatggaccaggctgaacgggaacgagaagaaggatatgtactcatcaatgagatcaggacccttgataaacagatcagagagaaggaatcagagctgtataaaaagaaagaagaattaaagggactacaggaccttctggcaggatatacgagtgagcaggaactggcagaaaagaaacaacagacaattttaagagaaaaaagtgatgctgccaggtatattgatcaaaatgccagggatgcagtcatcagggatatctattcaggaactgaagagaagatccaccagatcctgaatgagatgaaaacaatcgggaggttgaacaaagactgctcggagcagaaacgactggttcattcaaagagacaggacctggaagacctcaaaaaggaccgggagaagaagcaacaagcattacaggtacttgaagaccagcaaaaaatccgagaaggagaactcgaaaaaattctgtccggcaccacaatcggagaactgcgacagaggcgtgatgataaaaaggtcagaattgaacatctgaaccggctgaaagaaattttgaccggaaaaagagagatatctgcaaataaagaagcactaagtctgaaacgggatgaccttatccattacctgcagtcatccggatatgaaaaagaacgcctcgggtcagatctcaaacatcgtgaagaactcctgactacaaagcggacggctgcattcctagcagcgaaggtcagagatctcgccacagagagaaatcagcttgtagacggagaaccctgtccactgtgtggctcccttcaccatccatttgtaacagaacaggagattaaacctgatgagatcatcagtgattttgtagaagaagaaaagaagatcaaggatcttaccagggaactgaccagccttacggcaataattgctgaaaaagaaggtgagctcaaaagatgcactgaggatatcaccgaatgcgacgctcaactgaatgaactgaaccgggcatggaaagagggggctgaactccatggcatacatgcagaaaccgatgaaagaacccttgaatcatgcataaaatctgctgcatcagaactcgggagtctcgaggcaacactccgtactgcagagcaatatgacgagcagatcaaaaaagcatctccccttattagtacgaaccgggaaaccctgatctcccttgagaagaactacagggagaaggagtttgagattatatcaggtgaaaccagaatcggggagatacaggagctgattgcagccagtgaatcgaagatatccacctcttttctagaactgcagccagtacttgccgatctcgggtgttccataaatcaggataccaacatgccggcactcctgctcactttgaagaaccgacaaaaaagatttcaggagcaggaagacaggataaagtcctgtgaagtcgggcttcaggaattacatgcaaaattgagtggtctcattgcaaggatatctgaaaaaaccaatgagataaccagaacgcatgaagccataaaggagaaggaattaacgctgcatgccctgaaaaacgagcgaaacaataaatttggagagaaggatactgactgtgaagagaagcgtctggccgaagcggttaaaaaagccagcgagatattcgagaccaggcagaaggagaagaacgatctctccaaccggctgcaatcactcgaaggtcttctttcagatcttgagaaacgaatttcagaagctcaacaggacatcagttcatctcttgacgaatttctctcccatatccgacaggcaggatttcaagacgaagaggcatatacatctgccctgatgaagcaggaagagatggtccggcttgaaaaggtatgggaagatatcagaaccgaagagacccggatacgagagcggaaaatatctgcagaaaccaggtatgtggaagagcagaagaaaaatctcacgacaaaaccggctttggacctgaaagcagacctagaggagttacagaaacaaaaagacctatatatagcagatattgggaagaaccaggagaaacttatcagacatgaagagatggtacggcagcagcgtgagaagattgccatccgggatgcccggcagcgggaggtgaataaatggcaccgtctcaatgagctcatcggttcagcggatgggaagaaattcagggtgtttgcccagggactcacattctgtattctcctcagtcatgcaaaccagcatttacaacgcatgaccgaccggtacatccttattcaggacaaggatctccccctggacatgcaggtcatcgacacctggcagggtggtgtggtcaggtcagtaaagaacctgtcaggaggagagattttcatggtcagtcttgccctggctcttggcctttcacatatggcaagtcagaatgtcagggttgattccctcttccttgatgaaggatttggaacgcttgatgatgatgctcttgaaaccgccctttccacgttatccggtcttgagcaggaggggaaactcatcggcgttatctcgcatgtatcggcactcaaagagaggatccctgtccgtatatcaatagagaaaggaagcaacggaaggagtacaattcttcttccctatctcttctgaatgaatgaaacctttatctttgttgatttccatttccatgtatggcaccatcagagtggtataccgcgattctcctcatccttctctccggtcttgttatatccggagtgagtgcagcagttattgactcatcatatgtgtacgggcatccgcccagtgcaggtaacattgtcctgaactttgacaataccggcaatgacctggacgcggttgtgattgtcactcttggcggaaatgccgatccgctctatgcgatatatattcctgcggaggattatggcagtatcaagagtattggtcagggacgatttgatgtgtatttgaactcggggtggactgggacgagcggaaccgtatcttccaggatgggaagttttacaagatctcaaccccggtgattctgaaggacaataaggatagctacacggtgtacctctatgataaagagggaaaacctaagagagtgaaagaaataacgcagaaagagatgccggatatcaggccacggatctgattccggattattttaccctgttttcacaccctttataaatatttgatacaaatacgctattttacataattttacagcatatgataatacggcccgatcattcttctcaaaggatatgaatagtacattttttgtgttacaaacaaagatagatgatcatgaaatggcatgaacactgccactatatggagctcccccgtgaataccctgttacggaacttgccagatttcatggacatctgggcccgtttattgtaatcgggtaccggatgggaagatatgcattacaaaaattaggtgacaatccctttgccatgaaggccagtatctattgttcaggcactaccccgcagtcgtgcctcgctgatggcgttcagctgggaagcggatgcacccttggaaaaggcaatattgagatcgtgaaatctgatgtcgtgtacaccgagttctcatctgatggagtgaaaatccgtctaaagccactggcattaaaacagttgccccaggatacaccggattatgaactcgagatcgagaaatatgctgctgacctgtattctctccctgatgaccagctcttctcggttgaggtcctctcatgacctgtggcaaagaccacatcatccagctcaaagaagtatggaccacctatgaaggcgcagaccttccggtcataaaagatgtcaccctcaggataaaaccgggcgagtttgtcgtgattgggggtccgaacggagctggtaaaaccactctcctggaaacaattgcaggactgcttccggtggtcaatggcagcgttcaggtctgtggtcatgacgtcatcaaagacgggtgtgctgcacgtaagaagatcgggtatgtcattcagaattttgattttcacccgtacaccccgttcaccgttgaggaggttgtccttatgggacggtacggaaagattggatggctgaaacgtcattccagcagggacatggacaaggtcacatcggcaataaaccagctgggcctgagcctgatgcaaaagaaccagatcggaaaactctccggaggacagcagcagaaggtgcttattgcacaaaatctagcaaaggatccagaggttcttctcctcgatgaacccttcagcaaccttgacatggtcactcgggaagaagtcagcagactcctctgccagatagccgatgcagggattccggtccttatcgtatctcatgcatttgacgccctgccagaccgggacatcagggttgttgtcatgcagcatggggagatcatcctcaatcagctctctcatccgtctgatgttggaaacctggttcgttctgcctcggtggcagcctgatgctggaatttctcattccaaataatgtcatgtgccatgcagtggaggcgatgctctttgcctccctgggctgtgcgatattaagtgtcctgatcacccagatgaacatctcatccatcgggtttaccatgtcccatgccgcttttgccggtggatcagtcggggcatttttcgggtacgcagttctcccgtcagcagtattagtaagtatcctgaccgcttttctgatggggccactcagtgaccggaccaggatgcatactgatacaaccctgggggtgctcttcgggaccatgatggccgttgctatcttctttattgcactcatgcaggggacgggaaagggctttgatgcaagttcactcctgtatgggaatgtcatctccctctatcgggaggagatctatgccctggctgtcatcacctgcaccatcctcatattcctgataatcttttacaaggagataaccgcgatcgtctttcacaaacgtcttgccgaaattgcggggattcaggtgaaaccggtctactatgggatcctgtttctgatctcagtcatggttgccctgagtatcccaatcgtcggcggactgctcctgtatgtctggctggtgaccccagctgcgatcgcctaccagttctgtaatactatgcggaatatgttcatcatggcaccggttattgcagttattgtcagtgtcacaggtgcgatatgtggtattttgtactccctcccggtcggccctctgacggcggtgatttttagcggcctgtttgtcggagcagtagcagtatcacctaagagaaagatagtgtttcacaatcattaatacgaaaaatgaagaagtaataattatgaagcatgcaggattattgctgattctaggcatcatcattgctcttattccgggggcaatggccctgaacgttgtaacaacgacctccgtcctgtgggatccggttcatgagattgggggcgaggatgtaaatgtcgtatacatcgctgacccgaccgtctgcccgcacctgcagggagatattctgccaggcctgattcagaagaatgcagagaatcttgagaaggcagatctgttcctggcccataactccagtatggattttgcaaccatgcaggcggtagaaaaattccgtgactcaaacgggtttggaaagacaaactggaagatcctgaagcaggacacttcatggaacacccctgataccgctgtggaacttgcagacacggtccttggctggctgaaagcagcagatgccaccaaagcaaaggcttttgatgaacgtgcacaggcatacaaggacaagattatggcagcaggaaccctgaccgatgaggagaaaggtctgcttgcaaagaagtatgcagttgtcatggcctggcagagagagccggttgagaaatggcttggtctgaatgtggttgatttctttgctccggagttcgcatttggtggcaataagacaccggcaaaggtagttgacacattgaaggcagatccgcagaaactctatgcactggatctcctgcctggtggcggaaagatctacgtgattgagaatatgcagtcaggcgagatggcaaagggtattgcagaggcacttgaagatatggcaatttatgcaaatcgggtcatatttaccaacttcccgaaatcagtagagggcgtggactcaattccggatgtgctgacatataacaagaacctggttctccagtaactcttttttttgtctagaaactatagtgataatattcatatagattattacccaacggataatagtactactgtgatgatctcaatggtgggagtacatcagaaaaccagtatcaaccgattcatcattgctccatcaacataatcacataacaccccggacaggttcagtacagcctgcaggtcatcacatacccaccaaaaaaagggggatattccccctgtctaatcagtattttgcatatcttttctaaaccccctcgcaatactgcctcctcccaataccaggaggtacacgactacaccaaggagaatgatggtagagcctgaggggatgtcaaagatccaggagagaaagatacctgatgttgtcagaatcatgcttatcaaagtagccctgaccatcataccattcagtgttcctgaacatggccgggcaatggctgcagggagtgtcagaagggcaatgacgaggatgataccgacaacctggatgagaaccactactgatatcgctatcagggacagaaccaccagatgaagactcctggtcggcaggtttgagatggtggcatactcggcatcaaatgccacagcctgcagtacagggtacagaatccagaagaggaggacaatactgaccgccaaaagagcgatcatcatcagatgttctggtgcgaccaggagaatattgccaaagagataactgaagaggtcgggagtatacccaggggtcagagagagacagaggataccaaaggccatcccaccggcccagaacgcaccgatgagcgtgtcaatgtgctcttttgcccgttcaatcagcccccagatgagagcagcaataccaagggtgaaccagaaggcaccgacaaccgggtcaatacccagaagatatccaagtccaatcccgccaaaggctgcatgggatatccccccggctatcgatatcatatgcctgacatagatataactcccgatgatgccacagatgactgatgccataaggccggagagaagagcggaccggaaaaattcaaagctgagtgcttcaatcatggatgatctccatgtcgctccagtacccggtgtggaatatccccatgggtaatgagatcaaccggacacccataggttcgggagatcatctcaggtgccacttgatcactctcatgcataaataaacgccggttcagacaggcaacccggttaacgtgtctggagaccacaccgatatcatgggttatcattacaatggtgatttcctttgctaacgaggagagaagttcataaaagtgttcttctgtcggagtatccacatagaccgttggttcatctagaatgaggatatcagggtttccggctaacgcccgtgcaatcaaagcccgctgccgctccccaccagataactcgcgaaccggccggggcccaaggggctcagctgatagcctggataatgccttgtctgcagcagcatgatcctcatgagtatatcgtctgataaccccgctctttctccccatcatgccggtcagaaccatttcatgaacagtaatcggaaaggagaaatcaaatgcatgcatttgaggaacatatcctatcctggccctggtatcaggtgttgccggtgagccgaaaagaaggatctccccggtatcgcaggggataagaccgaggatggccctgaccagtgttgttttcccggccccgttcggaccgatgatagcgaaaaagtcacctttcctgacctgaaaggttatcgaatccaggactttttgctgattcctgatgatggatacattggtaacctcaatcaccggttcatgattcatgatacccctgatattctctctgctatctgtcgcatgttctcaaggtaatccccggcaagcggactgataagaaccatggtcccattcagctcacgtgccagagtctcagcctgcttcgtggactcttcaggttctgcaaaaacaatggttattcccatggattttgcctgtgtgataagatctgcgagctgctttgctgatggttcacggctgttctcttcaaccgccatctgggtcagatcatagtccctgcagaaatatccaaaagcaggatgaaatacgagaattgtccttgattttaactccttgaatgattcacggatttcctggtcaatatctgcaaggttttcgaggtacttgtcccggtttgaatagaacgtatctctcatctccggtcgtgcatcggccatcgcttctgcagtggtattgacgatacgggcggcattctgaagtgacagccagacgtgggggtcaaaatgatcagactcctgatccgcttcttcaccctcatgctcatgcgtatgtgctacacggtggaccacgatggtatgtgaggcattgatgatcggcatatccggatagatccgggttattctctccatccaccggttctcaaactcaattcctgaacccagtgcaatgtagagatctgcagactctagaccggcaatctgtgacggggtcggttcaaaggtatgcggacttgccccgggcgggaccatcaccagcactgaaacaggataatcacctgcaaccgctctgataaactcctcctggggagggatggtgcaggcgaccaccagggaatgggaaggagagacttcctgctgttcaatgcagccacatacacagagaaaaagaacaacccagcagagaaccagaaatacctgactacaacgcccaatatgatgaaaaatatggcggttttccatcttcccgaattgaagcttgaagctaatattttccattttcaaactccgcagcagagaggatcatggtcaattaccccacatgccgcccggcttggatgacctaatgaacgacatatctggtcgatatgaacctttggaaccagatgttctatcttttcagcctggatacatgcatcatgttctgaaagaccggcacgggtaaacatgagtgagaggatacggtgtcgacgctgaagaaaacgggtcagatccttaccggcatcagtaagaaagaccattttataggagtcataccggatatacccggcttgtccaagttcatggagagaacgtgtgacggtagaagcccggatcccaaaattttgtgcaatttcaccgggttttactccggattcgcgggaatggatgaactttaaaaacctgatcttctgcggtgtatcaatccggccggtcatatatttcatatagaacagaagaagatataaagctgccagctaaaattatgaaaatcctgtcctgagtcagaattcagagaggaacctgaatcaggaatcatatatttcaggattttgccactgctttaatgtcttttgtatcgttttctttccaaacagggtatcccgaaagactggatcagggcgaatcccgagttcttctgatacggcgaatacacatgcatgtttcaccaggcaggctctgcatttcggtccaggaccgcaccacgttgagccgatgaggtagagtggccgatccagatcccagggatcttcaggtgagagcatcctggcaagccgccgtgctttcatgggcgtgatcccgcttccatccccacatatcatccgccccagaacccgtgaatcaacaatatcacccacaatatcaaacggcccctggataatccccaggtcttttaatgtgccaacaataagacatgcaattgaccggggaattctgaggagtaagagccgtttgtataccgactccggatcctgctcatatccgatccatatctgccggccgtcacctgcataaaatctgatcatcagggtagctatcgtataaagccgggagtgaatctttggttcgggatggaggttataatcaaaaaaacgttcatcccatccctcctgggtgtgatcaacaatctcctgccacagggattcaggattgtccaaaacctcctcggtgaaaaaaaccacattatcccatacatccgtctttcctgatcgatattcaagaaaacaagcacataaaaatgcatttgcctcttttctggtcatctctgatgaaaaagtatcagtgagcaggaaagagtcaggagcacgaaaccgtggatgctccctcgtcagtctgaacaaggaatcagatacgatctgaagtacttctccggtaacctggcttatttcagcaggatcctgaccggatacagaactcatgagagggattaaccgggccatgcggggggtatgctgtgtcatgactgtaataagggatggagtaatttgagtgcctcagaaaagacttcaacatcagcatgaagggcaggcatggccatgaccaggtacaccgggtaccgatcatcatacacccacctctgtaccctggcacgtattcctgaaatccggtgatcacctgcatattgctcctctatctgtgaacaaaggcctgctgcctgaacataatcagaagtatatccggtccaagatacgatctgacaatgcaggtattcctcactcaattctttcataagaccagccatagtataccagtcatcaaactgatcaagggccgccagaacgtcagggatttgcggattttttaacaggtatttcccgtccaggtcaccaataagtatcttctgaaagggtctttttttaaatccttcaattactgtatacctgatccctgaatctgacagatggtttaacgcatcatccagattggtactgtgaaaagaagctgatgttttctcgtcatctattccgattgccgggtcggctccggcctcaaaatgaagtgtcgtatccttcccaagtggaagaacattataatgactcccgatatgcttgatagttgccgttctgccacgatgtacaagatgtgaacagagctcaaggatgaatgttgttttccctgaaccagaccatcctgcaatatgaatcactttcataaaaaagacaccccacccttaccaagaacctgatctcatatcagacacagaagtttttaagtaatactatatccaattcccctcttacggggtatatatgggggatgaaccgccattgattttttcatcattttcacgcaaattagcggcagtcatactttttgtactcctgttttcccttattacgctggtcatcgtctggtactcggggtcactggctaccctggatgaggaatttaaaaaccggcagaacctcaccgaccagattctgaaacaatcagttatctggattgaccgggggatttccctgtatgaactgcaatatattccctccttggagcaagcaatggatatataccataccgcttatgaaaactcggggggagatatcgcaaagattaatctcagcgcattaaaagagcaggtggatgcacagctggaggggacctatgacttttacctggttcatgccgatgggcaggtagtgaaaagcacctttgttgaagatatcggacttgactttaaaatgtggccgaagttttattcggtcgtctctgcgatcagggagaatggcacctttgttccggatcggatggtgcggggatatgcgaaaaatgcacccatacggaaatttgcatacatgggaaccagtgacaggagatatctgctagaaattagcaggtcatttgaccggttactaccctacgcatccggtgcatcatacaaagaactcatcaataatcttcctgatctgaatcaggatatccggtctattgaactatacaattcacgatatgaactggtctcgaaatatcctgaacctgccgcaaacgaacagccaaatgcggaaacattgtcgaaaatcatcagaacatttgcagataatacaaattatgaagagacggacccggtaaccggagatattatccggtacacccatcttcctatcagtgattcagagtcaccatcagcatccgagatgtttctggcggcacggacggtatattcaactgatgaccgggatcataaaaaactgactcttactttgatttttggtggcttcctgctcctcacagcgattattgcagccgggggagcctttgccgcgtcacgatacctgtccaggccgatcgaccggattgttgaagatattcagcatatcgcagacggagacctggaccaccggatccgcccgaccggatcatctgagttcaatactattgaaaaagccataaacagccttgtaacaagtctgaaagggacgattaacaatttgaaaatgcgggaggaagagctgcttgaggaactgggaaagagatggaaagcagaggagaattatcggagactttttgaatctgcacacgaagcgatcttcatcctgaaagataccagaattgagagttgcaataatgcagcaactcatcttatcgggatgaacatgaaggagattatcgggaaagaacttttcgaattctcaccaccgacacaaccagacgggagagattccaaagaggcatcccgtgagataattcgccgggttacccagggtgatttatccattattgaatgggacttcatgaagaaagatggaaaaattttgaatacacaagctcaatgcagcgctatcctttccggtgatgaaatcctcgttatgataatattccgtgatgtaaccgagcttttggagatgaggaagcgggagattactgcaatatcccagattgaagagaatcttgtcagacttgctgcgataaatgatcagatcagaaatcccctggcatctatcaccatcctcaatgagttgcagggcggggattatgaagagaagatctttgagcagattaagactatcgatgctttaataaatgaagttgataaaaactttgtgaaaaccgataaagtccgtcttttcctgacaaaacactatggcatacaccccatcactcctaaagaggagaaaggaaagagtccggcccatcgataatatctccggtgctttttcattcatccttatcatcctgctttgcctgctctctgtaggatctccggcatttggagaacataccataagttttgctgcttttggagagatctcattctcggaaggagtcaccgaggagagtgtccctatcaggccggtggttgcatttgaccctggcaccgtgaagatctgtgcggtcttcccgtttatgaacatgcaagacgggatgccggtcgaggtagaatggctctataatgacgaatggttttactcaaccgaagaggaatgggacgaaggggaagagggaatcacacaccggtcaatctcatgggaggatggccgtgaactggacccggggatctacaccctccggttattcataaacggccagcttgcccggtcggctgatgtggaagttctggcaccaatagaggaggaaacgccgaaacctgcaagaaaccctgaagacctcattgatcctgacctgatgaaagcatgggagattcttgcgtattcagataatgacctgttacaagaccttgccggccttgttcctgattatgggatagaactcaggctgactgacgagatcgactcaaacgggaaatatgtctatgcaagcggtaagaaagaaccagggaaggtttacatctcatgggatttctggaagagaaaaacatgggaagaggtgagcggaaccatcgcacatgaactcacgcatgccgtgcagcatctgaccagtgatgaagaaacattcggatgcaccatcgagcgggaatatgaagcatatatggcagaattctatgtgctcatggagaccggacgggaagatatcctcatgaaatcctggtcggcgatctacaatccgaagaccgggaagatttggaagaatgagctctggaaggcgcttcaggatgcctatgaaacctgtcctgaatactaattatttactcatatgagggaaacccgagagttccattgaccctggtgcaaaaacggctctttcttctttcagtctggtgtataatcatggatcacaacctttaatctgttcccgcacgaagtgtacgttactaaccggcatgattagctcgttccttcagattgcctttgcagccatctgctgctgggttctctttatcaccattgatatgatctgggcactgcctcgggaagggggcgttgtcggagcaaaagcgattgcagcagcagttgagaagactggaggagatctcaggggagggaccatgatgggcaatattgtatcatcccctgatgcatcggccgggacccttcttgctgcctgtggagtatactgttttggaataccagggggccttattgcaacggttctcgtgtatattggaaaccgcatctgttatgatccggggtatgccgggacaacgggatgttttctggcaacctttatggtataccttgggacccagatcgggattccggctgagttcttcatcatcggaatggtaattgccatcctgactatacaggggatatctcaccggcactcaagcaggctgcttggagcaatatggaggattcggagatgagcatcgacggaacagaagacctgcttggcttgatatccggcccattctcctcctcatatatcagccccccgtctgagagtgctgaacttgcagccctcatgtgtggccttattgctctctatgcagtcatcagaatcattcttgaacaggatgtcatgcgtaaactgccattcctgaatgtattcagctttgctgtttccggaatcatggcccttctcatccctcacccgcttgggattattgccgcagcaacctattttatcggctcgacatttgaatcaaatgctatcgcgagcacgtgggccggaggggtggaggaatgaacaccctgctcctgatattttgtgccattgcccttattggtggattgtatgcaggttttgcacgggatccctatgcaaaacttatcgcaatcgggattattgcaggcggcgtaatgcccctcattattgcacggggctatgttgatgtggcagcagcccttgctctcataataccactgtcaaccatttttgtacttcagctctgcaaaaagggggccgcatgaatcctgagttttttgcaggtctgattctgctcatcatcgggacgtggataaccgcttttccccgtgaccgggagtatctgactcgtcttattaatctggaaattccagccttcggactacttctcgtggccttgtcatttgatgagacgctggcattgctgacatttattgcggtatcaaccctgactacttttgttctcgtactattgatcgaaaggagggcaaaggaatgatccggtggatagggcgcaactttcggacattttcaaactggatgtcaacctatgaaaacctcgttgcagtatacgctgcactaggaattttcgttgctatctgcggattgatcatggttcccatgcttacctaccatgaggaccagatttattctaaaacaataaaccgtgattcaactcttaatccctatgaccggggaggtattccctttacaagggcagatgtgaaggcccagtatccggaaaactccccgacggtcggatttgttacggcatacctgacgccactctcatggttccttgcaaatacaacgccatatcttggaaccacaatcgttgcacatcctggaggaatccttgatgaaatcctctataacacccggggccttgatactgtggtcgagacgagtatcctctttactgcatttgccattgcttcattcctgttcaggaggaaagaatgatggatttttatcagatcggtcttttatgcacccttatctgtgtaaccatatcattcattgctctcttcagggaacgggatgatatccataaaatccttgttgtggacctgatagaaacgacaggccttgttcttatctgtcttgtcgcaacagatctggcagaagccctgatcctccccggtcttgtggtcggtatttctgaactcctgatgctgactgaactctatatcagaaaggagaaactccctcttccggcatataaaccgattcggatcgaggtcatgcggaccgcaccacccatcatcacctttgccctggttgtgtatgggattatcctgtcagggttctcaggaggtgcagtcgcaggaataggacttgtattctacttcctctgtaagggatatgaagagcggtttgcactgcttgaaacaatatccgggtatgcatgggcactctggattgtggcattctttatattcatgatcttaccacaggcctggcttattgcggtgatgctctccggaggggcgattctcgttaaagtaaccaccaagatggcacttatcggcaccatgcaggagggacggaatgtttaatctgcccattgaaggagaggaactctttgtcctggagttcggggacattgtcaattactttagtctatacacgacaaccctgttcctgtttgcgaccgccttcatcatcatcgccatcatcgcacgaccggagcggcagacagatatcgtctttggtactgatgcgatatacaccaaggagataaatccggacaatttgcgttttcagcgatttatggcaatcgcctgtggtcttgctacacttggggcagtgagctcaggcgacctctttaacttctccctttttaccgcactcatcgggataaccaacatcgggattgttgccggtgtaaacaaccggtatgtactgaatgcggcatataattacggaatcgttgcgatggttgcaaccacgttcctttttggcggtgcagcaacggcccttgggacctgtggaaccctgtccatttgggaacttgccggccttgggatggtccccctggctgcaaagatgttcctggtccttggagtgatgggagaaggaatggctcccttttatatcgcaaaggctgagatcacccgggcaccgggagcaccctatgtactgatgatccatgtcagttcgctcctcatcttcctccgggtaattgagatcattctgacggtgtaacaatgaataaagagtcatatctggcagtaaccataattacagcagtcatcctcgggctttcggcatatgcggtatccattggaaccgagccgggatggtttccggtgatcgttgtggttctgacatttccggtattcaatctggcactctttctctggtggaatgcatcgaatacagacggggatatcccatttaccgggtattaatatgataacactgatacttccagcagtttttatcggccttttgtttcatggtatacatcgaaaagtcatcgcacggatacagggaagacctggcccgccgatctggcaggagatactccataccttaaaattctcctttaagcagacatggattccgaaaacggcaagcatgcctatgtttgtctttatcgtggcggtttccatagccatctggactggtgcattctatatcatcttcagtggcggcagtctgctcctcctcttcgcggtatttatgctccataagatcaccgaacacgggctcgggctctcgtctggttcaccatacggaaagtttggggcaatacggtcggtgatgtctgcagcatcagagattccgctctttgcaaccattgcagggatatatgtggtgaccggttccctgatgatcagcgatataaccaggtatcaggagatgcacgggcccatgctcgtcggggcattcccgatagccatcgccatgtacattgtcatactctccaagatgcattatggcccgttctcaatcattgaggcgaaagagatcgtatcagggaaccgtaccgagcactttggtgtctggagggccggtcttgaagtggcctatgcattaaaaaccttcgtacttctggcagcatttgttctgctctttatcggtgccctcccctggtacctgatgctccttgcaatgcttatcgtcctgatatcactctcctttgtctgtgcattcacgccgatgctctcgccatttgatgcggttgccctgcagacggtgatcaccggggtcctcgcagtgtatattatcattctcggggtgatgggatgaacctcatcaggatagctcttgctggaggagcacttatttatggagtgttattcgggattgaactcgtcaggggacatgtactctggcaggcagtacttggaattattgccgttgccgcccttgccctgcttcccttcaccaaaaatgagcatcagctccatgacggggagatgattgcagtctggatctgtattttgctcttcggcctgtatgcgattttgaaaagcggagggctggtatgacagatatatatgagcgtgacctgtatggaatgaaatttgccatcctgaacagtccgtaccataagagagtggtcactgcctgtgcagatatgctgggaattcctccgatgaaactgcgacgaatactaatagaaaaccttgatatgatgatgctggagtcacttgctgtcagatatgacagctggcgggaacggggcgataaagaggggggaataaggcgggagatagggtatgaacttttcacgacctatatccctattatctcccctgatgtaatggaagaggccatgcaagagtccaccaataacaacagtaacgctgaatatggaaaaaaattcctgcagtcacgggtatttgaggaggagagcaaatgacaacactccagtccctgaagaacgccgtccgtcagcggtcgattcatgtctgttatgtggacaccggttcatgcaacggatgtgatatcgaggtccttgcctgcctctcgccccggtatgatcttgagcagtatggcatttatgtccacaataacccgagagaggcggatgttctgcttatcatcggcggggtgactccccagtgggaagataaactcagaatggtgtgggataagatcccggagcccaaggtagcggtctcaatcggcaactgcccgatctccggatgtgtcttttccaggccacagacacttaccagggctcctgcaaagagttatattccgattgctgcagaggtccccggttgtcccccacgaccgactgaaataattcaggccatcctttcagtcgctcctctgatattcaaagactgggagttacggcgatgaaaaaaaccgttgatgtttccatacccctcggcccggtccatccgattttcaaagagccatgccggattaaatgtgagacctttggagagcaggtccttgccgccgaggttgaacttgggtacatgaagaaagggattgaacggatcatggttggccggccctggcaggaggtcatgttccttgccgaacgagtatgcggaatctgttcagtcattcataactttgtgtttattgagaccatggagaagatatccggggttacggttccagatcgggctgcatacctgcgggtgcttgcaaatgagctggaccggatgcaaagccacctgattgcaaacttctcatactgttataccatcgaacatgagaccatcgggatgtatctcctcaatatccgtgaaacggtcatggacatgctcgaatacctcaccggtgcaagagtcacttgtgcctacatcgttcccggaggggtgcgatttgatcctgacaatgaagacctgacccgaataatgaccgccatggatgacgtggaacgggaaacccgccggtacatgagcatgtttgaatcagggccgctcatcggacttcggagtaaggggattggtgtcatgacccgcgagcaggcagaactcatccatgcagtcgggccaaccgcacgggcctgtggtattaccactgactgcagatcagaccacccgacataccagaggctgaacttctcacccctggtacggactgaaggagataactatgccagggtcatgctacggttccaggaaattttacagagtgtggatctgatacgaaccatcatccggacccttccggaaggaaagatacgaggtggagggaccatcggacggggtgagaccacccataagggtgaagcgccaagaggtgaactgacctaccggattaaatcagatactcatggaagagtccaggagatatctatccagaccccgtctattatgaatatagaagcatgtgcacgatacatgatcccgggagtaacatcggttgcagatgtcacggcggcatacatcagctctgacccgtgcgttgcctgtactgagaggtaacagatgagatccatcctttcatatatccggcatatggcacgacctgagtgggtgaaaacattcttccttgcgaagactgcccccctctccacgccgccccatttcagggaattcccccatctgaccggaaaggaatgcacccattgctttcaatgcatgatgatctgcccggctcccggggcgattgaggtcatcagaactgataaacccggagagtggaaaccggtcatccatcttggacattgtatcaggtgtggcctgtgtgttgagatctgcccggaactggtccttgatgccggccgggttcatatgaaaaatgcacaggacggcacctatatgcagttccagttccacatcaccataaacccggtcacctgcatggggtgtgggagctgcacggttgcctgcccggtcaataaggagatagatccccaactggcagcaaaagggacgagcacctctgatgaagtcatcatgcgggtatacaaggggatcaacaccgtattccatgaagataaatgcaccggatgcaagacctgtgaagagcagtgcccgaccaggtcaattcttgtggcccgggtcctcgaacccctgcagatatcggaggagacatgaaaatccgtatcaataccggacggacagtgatccagggatcccatgtggaccggaagaattcaccagaatacttcagggagacatcaaccctccacctcaaccccgtggacatgatggagatcggaattgatgacggggagcgggtgaaagcaacaaccgggggtatttctgttgtactccgggtcatttctgatgagacgataaagcgggggaccggatttctcccgctcggaccctatgccaatgctctggttggcggaaccactcacagcaccgggatgccagactttaaaggatcagtggcagaaatagaggcgaccggagaaaaaatcccgacagtgggagaactgatgcaacatttgggagggctcccgtatggtagataaaatcaggcatgtggtctgcccctactgcggatgcctctgtgatgatatcatgatcgaggtaaccgacgggaagatatcaggagttgagaacgcctgcacgttgggagcccataagtttcttgatgatgcaggaaaccggctcaaaggccctatcatgcgaacgggggatgaatgggttgatatctcctatgaagaagcaatagagttcgcagttaaagtcctgtctgaagcggatcgtccgctcctctatgggtggtcagggtgtgcaacagagacacaggccatcggagctcaccttgctgaacttatcggaggagtcgtggacagcaccacatcagtctgtcatggaccatctatccttgcaatccaggaggtcggccaccccggctgtaccttgggacaggtgaaaaaccgggctgatacgataatatactgggggtcaaatccgatagaagctcatccaaggcacctgagcaggtatactaactatgccgatgcttatttcctccacaacgcattccgcgaacgaagagtcatcgtcgtcgatgtcagaaagacaccaaccgcagagatagcaactgagtttgtgcagcttgagcagggtggggattatcatgttctgtctgctcttcgggccatcatcagggggagaggggacattataccggatatggttgcaggtgttccaaagactcagcttatccgggttgctgatatgtgcaaaaaggcaaaattcggtgctctcttcttcggcgtcggtatcacaatgaccggcggtaaatataaaaatatcaggaatgccatcgaatttgtcgatgaattaaaccgccataccaaatggaccatatcaccgatgcgggggcattcgaatgtatatggatcaaacgaagtgttcacctggatcaccgggtatccctttgccgtggattattcaaggggtattgcattttataacccaggtgagaccaccgcagttgatatccttgcacggaaagaggcggatgctgcactcattatggcaagtgatcctggagcccatttcccacgaatctgctgtgaacatcttgcaaaaattccaaccatcctctttgatccctacccgagtgcaactactcacctctgcaccctgcagatcccctctgcggtaaatgggattgatgcagcaggaacagcataccggatggatggaattcccatcaggacacgcaaatttatcgagaccggttacccgaccgacaccgagctcatggagaagatttatgatcgcatcaggcaggtgaaagagaatgcgtgaactcctgattaagaacgcctatgtcatcgatccactccagggaatccgtggggatatcatggatcttcctatccgggaaggaagaatcgtagacaaggtgtcaggatcctgtgaggttatcgatgccggcggccacctgacgttgccaggaggaatagactctcatacccatgtctgtggaaccaaggtcaattttggccggtatatgagccctgaagacatgcgggccggaaggacgccacgacgcggtgcgatgtatccgacctccgggtatacggtcccgacgacatacgggaacagttaccggtatagcaagatggggtatacaacgcttcttgagggggcaatggcacccctggaggcacgtcacacccatgaggagtttgctgcaacacccatgcaggacatgcttgcaaataccctgtttgacgggaactggagtctttttgaagcagtcgccgacaaggatgtcagacaggctgccgcggtcatcgggtggacactttcagccgtcaagggttttgggataaaacttaccaatccgggcggtactgaagcgtgggggttcggggatgacctctcaaacatcgatgaaccggtcccaaactgggatatcaccccacgggacatcattgatacaaccattcaggcctgcgaatatttacatctcccccactcggttcaccttcactgcaataacctgggtatgcccggaaattaccggacaacccttcagacccttgatattccatctgatcttaatccgaaccggcagacgctctatctgacccatgtccagttccactcttatggagggagtacctggggcgatattcgatctgaagcggggaagatcgctggatcagtcaataccaagccacaggtggtcatcgacatggggcaggtcatgtttggccggacaatgaccatgaccgcagacgggccgatggagttccggctctacacactccaccacaacaaatggagcaaccatgacgtggaactcgaaaccggctcagggatcattcctgtctattacagcaggaaatctctggtcaacagcatcatgtgggccatcgggcttgaactggctcttttgatcaaaaatccctggcagtgtatgctcacgactgataacccgaacggagctccctttgtgaagtacccagagattatcggcctattaatgtctaacaagtaccgggagaaggaactaggtcaggtccaccgacttaccacagaccggacatccctcgggaccatcgaccgggagctgagctttgaagatatcgcggttatgacgagggcagggcaggcaaaagcgcttggaattatcgatgaagggaagggacatctgaaggaaggagcccttgctgatattgcaatatatccggtaaaaccggacgagaccgatccatcgctccagtatgaagaggttatcggagcattccagcagacgttatataccctcaaagacggtattgtggtaagcagggacggggaggttatgagagctgtcccgaaccggacgttctggtctcatgctgagcttccggatgatatggatgtcatgaagagcccccggtttgtggagaagttctcacggttttactcggtggatctggagaattacagggtacaggatgagtacgtgcagcggggtgttgcgatgaatacccggactgcataaccattatgtaatgtcacatcttatgggaaaactaatctagggggaggaattatgaaaaacatcacttttgctgatattgaaggggagatcaaaaagattccagtagataaactccccgaggtatatataataatcaaggaatattctcaaaaatcctccaaaaaaacgaaatcacattcgaatagaaaaaacaacatgacagaaactttgcaggaattgaacgggtgtataaaaattgaagatctcaatgactatgcaaacataaaaggtttaaaaaaaccattcgtgactgattatgctagcactgttgatcaggatctttccattgcatgcgtaaacgaaccttctcaatatgaagaatagtattattgtagatacctcggcattgatagcatatttcatccaaagtgagaaaaaacaccaatgtatcaattcgtatattaagacccatcccaaacaggagtggattattgtttcaaccgttttttcggaaattatgacgtggttacgattaaaagtccaccccagacatgcaattccaattggatcctttctccgtgagcaatgctactatcaccccataaccccatcggaggatgaagtaacctgggatatttataagacatattccgataaaaaatggagttttactgattgttcactcctcgcggtatcaaaagaagaaaatgtgccattaatcctctccatcgatcatcattttcaccaaatgaagagctttggagtaactgttgttccggatgaataattatgatgcaggtcacccttacgatgaaaccccgggcaaagcccttcctgcccattgaagcagagatgatcattccgatgaattttatcgggaaccgtgaactttttgtctgggaaggcaataagaaacgccgtcttgaagaagtattcacagtcagaaaagaagggaatgtcaactcaccagagaacatcgttgttattctcaggggagatacgagccgggtgaaacgggttggagagtatatgtcatccggaacgatcactatcgaaggtgatatcgggatgcattgtggtaatttcatgcgtggcgggaatattgtcattcatggcaatgctgacggatggctgggccgtgagatgcgtgccggatcaatcgtctgccatgggaatgccggggattactgtggttccgggtaccggggtgagaagcggggcatgcgtggcgggaagatcgaggtcatgggaaatgccggggattatcttggtgagtacctgaccggaggagagatccatgtgcatgggaatgccgggatgtttgcaggagcagagatgcgtggtgggacattgcgtattgacggtgatgtccggataccggcagcgaatatgtcaaaagggacatgcatagtccggggggtggttcatgacatgctgccgacatttgagaagattggagagaaggatgggatggtggtgtttcatggagatgtggcgaataagggaaagggagagctgttcgtgaagagtgtaggggatggtttgttccgatgattcaatataaataagaaccaaaattaatcttgtttttgtcagttcagatccctaaatcctgaataattaacaccatggagagtacaattttgaatatttcagttattggcggaggatatgtcggtcttgtcaccgcatcatgctttgcatatcttggtcatacggtacggatagttgagatagatacgaaaaaagcagagctcattaataaaggaatacccccgatttacgaagagaaactcgaggatatcctgaaacagacatcagggaaaaatctgtctgcacaatcccattacgaaggaattgatgatgcggatatcatcttcatttgtgttggaacacctccgcaggatgacggatcggcagatctcacatacataacaagggcttcagaatcgatcggttctgccctgaagggatcagaaaaataccatgttatcacggtaaaaagtaccgttccccctgggactacagaatcggttgtcattccagcagtgatgaaatcacttggagatacatcagattcagtcggtttttgtatgaacccggaatttttacgggaaggacgagcgattgatgactttttacatcctgaccggattgtcatcggtggttcatctgaaaaagcaatttcagtggttcaaaaagcatatgaaaaactggatgcactggtcattacaacatccctgaaagcagcagagatgattaaatacacatcaaacgcttttctggctaccaagatctcattctcaaatgagattggaaatatctgcaaaagaatcgggatcgatgtgtacgaggtgatgaaaggggtcgggtatgatcaccggattaacccgtactttttaaatgcaggtcttggatttggaggaagttgttttccgaaggatgtcatggcacttataaagcttgcagagaagaatggtgagaacccaatcctgcttaaatcggtgattgatgtgaatgagcagcaacctggcaggattatccaggtccttcacacgcggattggagatatcagagggaagaggatcgcggtcctcggtcttgcattcaaggataataccgatgatgtccgtgactcgcgatccatcccggttatcgatgaactcttaacacagggggcgatcgtctctgcatttgatccgatggcaaccgaatcgatgaaaaaaattttcccggacattacctatcatacaaacgccggagatgctttggaaggggctgatgcctgccttgttctgacagaatggcctgaattttctaaactcacagatgaattcaaccgaatgaaaagcccagtcatcatcgaagggaggaggatattgtcctgttccggcatcgaaggagtctgctggtaacatggctgaaatggtcagaaaagtagttatcccggcagcaggacttggaacacggttcctcccgataacgaaggcacagccaaaagagatgcttcccgtcgtagacaagccggtgatacagtatgtggtggaagaagcggttgcctcagggattgatgatattattatcataaccggaagaaacaaacgggcgatagaggaccattttgatcggtgtatagaacttgaggataaactgtcatcaaatcccgggtcgccatcacatgcctatgtagacattaccgagattccaaatatccattatatcagacagcgtgagccaaaaggacttggagatgcgatccttcttaccgaaaaacactgtaatgatgagccttttgttgtcctgcttggagatacgataaccattgcaccagaaggtgaactgacctgcacctcccagatgattcaggcatataataaatataaaaaatccattattgcaattgaaccggtccctgattataaaattccggattatgggataattgatgggaaagagatagaaaagaatcatttttcaatcgttgatattatagaaaaacctccaattgcacaggccccttcaaaccttggcgcaattggatgttatctcttcaccccggagatatttgcccagctgaagcagacaaagccggggaaagggggagagatacaactcactgatgctatccggaaattatccggatcaatcgggcttgttacgaactgcaggcggtatgatatcggtgataaacttggatggatgaaagcattttttgaactggcattacaacgggatgaattcagggatgatctcatggctatattacgggaagatgtgtgtgatacctaatcctccccatttttcattcaactcatttttcagtccattttgaaggttcaatcaaatcagcaattttattggacctgagaacaattcttgtattgtgatataattgaacttgaataggaaaataatacgtgaatatgtaataattatcgtactgtatgcactcctcaccgctatattaacatatcccatgattctacatgtgagtgacaccatcggcggaggggatgaggcattcacctgctggtcgttaacctggacgacaaagaaagttctggaagacccgataaaccttttcaaggcgaatattttttatccggcgaatgaatattccttggcattgtccgaacatctcaccggatggaccattttttcaatccccgtatatgggattactcatgacccggtattcacacacaatttcgtcagactcctgacctttgttctgtgtgggtttggtatgtatctgctcacatatcggtatacacaaaaccggtatgcggcttttattgcaggaattttctttgcattctatggataccggatggcgattcagttacatctcttagcaatgcaatggattccattgatgctgctatttctggataagttctttcattcattgaaatttcgggatattggcgcagcatcagtgttttttattttatctgctttgtccagttggtacgtggggatttttacaacgattatcggagttctttttgtacttggatacgtcatcctggatttagaagttcggaacggtttaatctcaaaaaaggcggttgtgagaattcttatttcactggcattcatcatcattactctcaccccctttgctcttccctattttgaggcaagtcagcattatgatgctgaaagggatttagatgaaccaatgaactcctcctggtcatgtgatccaatttttttaatgaatcaattcggagtacttttttttattttttccctggtgggacttctactgcccctgtcaagaaacacggctctaaaaccggattgggaatttgtgagatcccaaaaaatcccgataatatttgcagggattggcataataagttacgtccttgcacttggacctgtgctaaaaattaacggtgttcagacgggaatactgacaccgtactattttttctattccataattccttatatcgccattatacgggatctttcaagattcagctttattatgagtctagccggatcagttctgatcggatttggtgttgcagctattctttaccggataaaaaaggatgatttaaagacaattgttgctatagcatgtatcattcttgctattatcggatcatggcatgtcccggttcagattccagcctctcttgcaaccggagaccaggtaccggaggtgtatcgctggcttgcagaacaaccaggtgatgtgaaaattatcgaaatcccaaccagatggattgaagataactcggaatatacctattattcagtctatcactggaaagagatggtaaatgggtatagtgggagggatgttgaacttgcttcgaaaatcatgcgtgacaccgggggttatttcccctctgataatattgtttcattattacagcatatcggagtaaaatacgttatcattcatccagacagaatccggatagtggagaatatccctgatgaacaggcggaagcattcatctcacaatatttatccgttctgaatcaaaagatcgaacaaaattacaattccaccatcaggatggcaggatcatttggtgatacgatagtgtatgaaatactcgaaactccggaagttctgcctgaggatgttattttactctttcaaaatgggtggtttggatcaaatacattcccagaattttatttgaaagaagaggggaagatcaaagcttatgcagggacaaccggagagtatgaactctattttatggctgaaccaatttatacagaaaaaaatctctccttaaaaataaacggtgaaaacctgggaacaattactgctccagcaggaggtttgaccgaaggcaggagtaattttatcttacataaaggcatgaatgagattacattcacaagcacgtgtacacaattatgtgacattccggagatgaaaacaatatctgataaatgtatgagctttaaatttgtgaacctgacaatttttcaaccctgaaacggggttctttttacccccttacaaggataataatcccgctaattatcactaatgctccaaatagtcgcatgaagctgatctgctcatgaaagagaaaaaatgaggctatgaatataatgacaaaggtaagtgcaataaagggatacacaaatgaaagatcagcccgtgatagagcaataagccagaaaacggtggaaaggccataacataccgttcccccaattacccatgggctgagtagcatcgagataaaggatccagtcgtgacagatgtaatcggaccaatgtcagtcatcccaattttccataaaatctgtccggatgatgcaaataaaatcccgataaggataataattatcgtattcattcaggttattactcctttttaataaaactctgacggattctttcctcaatccgatccatctttttcgaaaggtaatcaatgatgaggccgattgaggtcagttgtatcccaaaaagcatgagaaaaacggaaataagtggataatattcgtggattaaatagtaatttaacagcctttcctgtacactgataaggccaaatccaattcctgcaagaagaagaaataaacccgggacagatatcattttcgcaagaggggaagtctcatgccatgcaatcgataataacgcacgaaacatccgatacccatcacgaatgggatgaagttttgacgtaccaacccgctcgcgatattctatgggaacttcagagataacataccccaatttcgctgcacggacggtcatctttgtctcgaactccaggcttttcgccgataccaggagttcatccatcatctctttccgaaaagcccgatatcccgtctggccatctgatatatacttaccactgatgtaggttgccattgtcgagaagaccgcattacctatccggttaaacagagggatattatgtgcctcgatatttcgaacgcccaaaacaaggtcagccccacgattcagttcagataagaaaaccggaatatatcgagcagggtaggtacagtctgcatcagtaaagacaataatttcgccagttgatttcctgacaccggtgagcaatgcacctaccttgccctggttctgggtatgctgaaaaacatgcacctttgcatcctgataatgagaggctatttcatatgtcttgtcctttgatccatcatcaacaacaataatttcgtcaacgaaaggataatattcctcaataacgagaccaattgcttcttcttcattaaaagcaggaataatcaaagaggttgtcataatatacccgtgaatgcgaatattccagaatgaagattttttaccgtgatattctggaaaatctaattatctcaatgttttgtaataatagatgataatagttcatgaattgtttctctgaatattctctcgtttaggtaaactcataacagagcagatgtcacgtgtcttttccgtaccattataaagggtagtaaaaacagaattatctattgcggaagatccaactatgaatatatctaccccatcatcatcagattttgaaattcaaaagatattaactggcctttcagatctatcatttcctgatcagaccattctggtaaccggtggttcaggttttttgggttcatggatgtgcgaggtccttctcaatacaggagccaatgtcatctgcctggataattatgcatctggccggccagaaaatactgaacatctgaaaaatcatccaaaatttacccgaatcgtccacgatatatcaaagccatatgatccagggagaaaagtcgaccttgtctgtcatctggcttcacgggcaagtcctcttgaatttgaacattatcccatccagattttgaaatccaataccctgggaaccatgaatgctcttggaattgccagaaaatatgaagccagattcttattcacctctaccagtgaaacatatggagaagctgcaatcttcccgacacctgaaacctaccggggcaatgtgaataccctgggaatccgtgggtgttatgatgaggcaaaaagggcaggagaagcattctgtatggcatatttcaggcagcatggtttggatgtcaggattgccaggatatttaatacctatgggccgaggatgagatcggacgggcattatgggagagtaattccccggtttattgaccaggctgtgcacaatgcaccaataaccatttttggtgaaggaaaacaaaccagatcattctgctatgtaactgaccagataaccggattacttcgtctggcaggattgcctgatttagcaggggaagttgtaaatatcggaaatccggttgaatggacaattcttgatttagctcatatgataattgaattaaccggttcgaagtccgagttatcctatcaaccaatgcctccggatgatccaacacggagggttccggatattaccaaggcacgggaaaaacttggatgggaacccaaagttgaactgaaagatgggcttatgaagatgctagagttgaaatgattatcaaagactctttttcagtcctgaaaggatatgcttctattagccagaacagagattaaagaactcataaaccaattaattcaggcaggcgtcttaagcgcaggacgcagttgactggctggtgattaatacccggcatattttttgcatttcggagtttcataaaaagagggtgggattacacttccacttttcgtacacactggtcaccggaaaaaaccagaacccatttcttcagattcggtattgttgataattcaggtgatgatatgtaccgtttcattcggagcgttccatcaatagtcatcctctctatctcctcttcagaactcatgcttcttttgaggtacttcaattcgaagatagggtaatgatcagggtgccagggatctcttttgagcagagtaagatcgatataaccttctgaaacctcatactccaatttaacctggtaccgactgctcatgtttgcatatgcaaaaattgcaattccagaggtcatactatattcaccaggtaatcctgttccccttctcaaatcctattgtgatgaaataatctttcgtaacgttgtaaccagatattgagtcaggaaccctactatattaaaaaaatatgacctttttttgcgtttcaaacattgcaaaacctcatacctgtaactcactccgaaaagtatcctccaattatcttaaaatatgcaccgatgatgtaatccactatctttcatatctcgaggatgtattccttctttttctgtaacccattatgatgtatcacttaaaccacagttgaataaacaaaaaactattgtattgaccatggaatgatacaactgtttctttcaggtttactggtttggggaagaaaaatgccaccatatttgtggtttcacgccgccgatgccactttcaaatcagaaaaaacaattaaacctcgttgtttttaaaaatactcatattttacccctgaaataagggcgaaatattgttctcacagcgggccggtatgaccacatctcttttcgcctagggatttatatggatcaggatatctctcaatagcgggccttgagaattgtggttttagaaggttttgagaggaacggccttcaattctgcaaaattacagatagatatggtaattaggaaaacgggtttttcacattgccctctgattttaaaaagaacgaaaaattttcgttttaaagaggagtcatttctggtaaaaggatactataagtaatagagttatataatttaaaactattatttaataagatcaaaaaactgcctcatacaactatagaacattatccataacttacttcctttcacataaccagtactaatgagtaatggtcacattcaaagaatatcttcatcaacttcggtttttcattcaagggtatgaatattatctgtttttactccttattctatccatcatcattggcctgattgatgcagggagtattgctcttttatatcccatgatatcagtgggatttcagataaatgctgatgccatccccttttacggagttatcgaatatataagcagcctgattccgatgggatcgcaatttgtccatctcggattattatttattctgctcaccggcatatcacttattcttcaactggcatactggaagattgcattcattttccagcgggaacttatcgtaaagacgaaaaagtcgatattttcaaagatagattccaacgattataaattttttgtcgatgcacggcagggagatctcatcaatctctttaaccaaagtccctattatgtccagcagacatacgaccggttgttatgcctgtgcacggatctgatgacctcaattctggtgatagtgatgctttttctgatttcaccaggaggacttcttctggtattaatcggggggggcgttttttatctcatcatcaactcaatcagcaaaaacatttcagagaaactggggaaccttcagatagcatctggtcaatccgaaaacaaggttatcaatgaatacataaccggcattaagccaataaaagcgctccatgcatcggaacattggggaaggcagtatattgatgctttaaaagtgtattgggataagtttgcggaactcatgttcattcagagaatccctatcattgcgataaattccctgttttatattaccattggagttattgttcttgtcctttacatttattacgcggataattttcttgtgataattccggttcttggaacgtttgctgcgggcatgatgaaaattctgcctaaagctatgaatatggggacctataagatggaactgaaaaatttttatccccatgttacaaccatccattcaattctccaggagaaaaaatatcattcggtagtaaatggtgaaaagacctgcaatgaaatcatatcagatatcattctggaggatgtcagtttttcatatggtcatgcaaagatcctgcataatgtgtcgatgactattgcgaaaggttcaatgactgctcttgttggtcattcaggatcaggtaagtcaacgattgcgagcctgctcctacgactctatgatcctggttcagggaggatacttgttaatggttttgatttgaaagagtatgatgtgaatacataccgggatattgtcgggtatgtaagtcaggatccatttgtattcaacgcaagtatcagggagaatatactgttcggagggctattttcagataaagaagtcattgatgcagcgaaattagcttatgcacacgaatttatcatggaattgccagagggatatgagacattggtgggagatcagggggtcactctctcagggggggagaaacaacggatcgtgattgcccgggctatgatccgccggcctgaatttttaatattggatgaagcaacgagtgcgctcgataatatttctgaggcagcagtacagaaggcgatcgatcaggtcgcgaaggaatgtacgacgctggtgattgcgcatcggttgacgacaatacggaatgctgataaaattgtggtgattgagaaggggagaattgttgaagaggggacacatgaagagttgattgagaggagaggtaagtattgggagatgagtgagaataaagcataatattctgtaaaccatatagtattctgtgtaattgacatccaaaatttgaaattaaagttttttgcaaatgaatgtctgatgtttagtaattataaaaactggagaataaaaatcagaattattaccaaaagattaagattttaaaaatgaaaacagtataatgctaaaaataaaaatttttgattatcgatgatttttattatttattttcaattagatagccgaataaataaaaatttacttgctaatggggcatttactaattgattacctcttttttactatttcacttgtcaattgaatatttggagataaaatggctgaaactttaggatcactatgtgataaacttaccatcgtgaaattgaagcaatatcacacccaggattctaaccgccttaaaagcctatcaattcaggagaggcaactatgcgaagagatagatggattcatttatagtgcaataaatggagatatatgtccagaaaaacttacattcacgtctaataaagtatataagctagaaggaaatgaaattgatgaaatatctggaactattggaaatatattttccttacttgctagtgtaaattgtcaattatggcatgagcaagaaaaagtctatgattttgaaaatatccacccgaatgaaaaaaacactgtagtaaaacagttagcgattcttaatctccagagaaatcaatgcattgatgaaattgataaaaattttcaacaaataataattaaattacgcaatggttataaaaaataaaaagagattaaaatgtatttagagataaaaaattgccgaatctgcaagaatagtaatttaattgatgttctctctttaggagaacaaacacttacaggagtgttccctaaaaattacgatgaaaatatttcaaaaggacccttggatttggtttggtgcacaaaatgtgggttgttacaattaaaacaatcatataaccttgttgaaatgtatggagataattatggatatcgttcaggattaaatgtctcgatggttaaccatctaaaaaataagattcggactttagagaactcagtaaatcttactgaggacgatattgttattgatattggaagtaacgatgccacatcactaatcgcatattcaaaaaaatgtcgtagggtaggaatagatcccactggaaaaaaatttaagcaatattatcccgcaagtgttgatctcattgaaaattttttttctgctgaaatatttttttcgaaatatccaaattgtaaagcaaaaattatcacatctattgctatgttttatgatctagaggaaccagtatcctttgtcagggacatagagaaaattttgtcagatgatggtatatggcattttgaacagagttatatgccttcaatgctacgttcaaatgcatatgatacaatttgccatgaacatttagaattttactcatttaaagtcataaaaaatctattagaggaacatggtatcagaatcattgatgtacagatgaatggcattaatggtggtagttttgcagtaacagcctgtaaaaaagatgcatcatttaaatccaatgaaccagttatccaatggatgctaaaacaagaagaggatatgttactagatacaccaaagccctatcgaaattttgaagaaaaggtatttctccaccgtaaaaatctattaggtctgattgaggccttattaagtgatgggaaaaaaatttttggatatggagcttctacaaaaggaaatgttttgatacaattttgtgggttatctagcaaacaaataccatatattgcagatgtaaatattgataaatttggatgctacacacctggttcgcatataccaataatttcagaagaggaggctaggacaatgcgacctgattactttttagtttttccttggcattttaaacactttatacttgaaaaggaacacgaatttctcgaaagaggtgggaaatttattttccctttacctgaaattgaaattgtgtaacatttttcataattaatttatttgcattgtgtgagaaaattatttaaaatataaacattataataaaatttattatcattaaacttattttttaattcggcgagaaaaaggtgtataaaaatatatatgtcaaacaaaatatgtgacaaaacccttaatgaaaatatctgtcaccataaatctacatgtaaaagggaatattctattgcgatattaattaatcctttagaaattagccatattgaattcaattatcaatttgcggtgtctctagtaaatactattattgcaggaagtaaatcatcacatgatcttgttaaagtaatattaggcattcaggaagaaataaattctgaaataaacccatttttaaaagatttagacccagaatgcattattagagaattttggtgggaatatgtaaataacgataatattgaaagaattcgctatcttgaaggaataaaaaaatctacatttgcaggaaattattatattccaagagatgggatggcggatttttttgatacctcgtggtggataattatatctaacaacttatattttaacttagctgctttgagaaaaacatcatacttagttccaaatccaattgaatatattggaacaaatggatctctaaaagattctttaatttttcatcactcaaatgaaatttccaattatttaactttctttccatttttaaaagaatattttgtttcaaaatatttaattccagaaaataaaattcatttactaccattatttcgatatcttccagaaaataaaataccttttgaaaatgaaaaggcattaaattattatttagtttggcaaatagatattggatcaatggatctatttattgaaaatattgaatattttatagattatttttctgatggtaattatgaattaacaattatttttacaaaaaacggtacgccatttcaaataaattactattcagatcctgatttattaaaattaaaaaaaatactagggtcaaaattcaccaagaaacaacagataaaattttccctaatgccatctagaaaggattattattttatgttgaaaaatgcccaatttatttttattcctttcattgataattatatatctgattatttattagatatctcaataatgggaaaacaggttttatgcatagaacatccaattctacattatttatgcaagcaatactctatcgatgcaaatttcttcaataatgcgaatgaattaaattactacttatcttgcattaaaagaggggaaaaatcattagaattcggagattgtgattttattaagaataagcacaataattataagaatcacatacaattttggcaagaattaaagaaatactatgaaaaatagagaaattggtattgcaattggatttctaccgggagaactctctattggtgaagggttagcacggttattatcgtttatcataaaaggattgatagagaatagaatacagattacgttattatctccagaatgggcaaaaagtgacttggaaaaaattcttaaggatattgaattacataactctgaattcataagtattattactacgggaaaaatacctcttatttttaatttcaagagaagattagagagtttatttttaaatagagagaaaagatatagaaataaagagaattctaaaagcattaaaccattcaattgggctgagttttttttagataggattacaaaattttgtgcaaaaataccatttttaattcaaattatattaatccctattttttactgtatctatttttcttttatactcttaaatgataataaaaatttattgtataaatccaacagaattggaacaaagaatcattataatcctgataagaaaatatctaaaagaaaggtgcagtcattttataataaattgtctgatgaaattattaattgtgaatataaaaaattatgtaagattgcacaaaaaaatgagagaattaaatcatggatcatccccactttattttggccattaatcgttgaaaaaatacccaatccgattgtaatagctccagatattgttttctcagcatttcctgttggattcgaattaagcagcagagggtacaatgatagtgatcattatgtgaaaatgaaagatcattttcaactttctttaaatttcgcaacacaaatcataacatatagtgattatgtaaaaaatcaacaagtttgtaaattttttaacatagatgacaaaaaggtatcagtaatccctcatgggcatatttcactatcagataatgcatatgtaagggagaaaattcaatactttgatccaaattttcaaagagaaaagtcggtccaaataattatgaattatttggaagagaataatttaaatcaatataaaggattcatcgacacaaaattcataatgttcacatcacaaatccgaccccataagaatattttaaatttagtaaaggcaatttataagataagagacgaaaagcatatttttcttaaattaattctcactgccgatttttcaactgacgcaaaaattatgaaaaccattaataaataccatttggaaaccgacataattcaatttactagaatttcctcacaattaatggctgctttatataatttagccagtatcgcagttaatccatcattagcagagggaggttttccttttactttttccgaagcctattcagtaggtacaccctcaattatgtcaaaaatacctgtagtggaagaatatattttagatccaaacctcaaagacattatgctttttgatccttacgatatcacagatatggtaaataaaataatatggggtgtatttaacagggacctattattcaaattgcaagaaccattattttcaaaatctgtaagccgtagttggaaaaaggtagctgaggattattataatatcacccaaaaattatgactaatgatactttagatgatttattaatatttggttgtggtggacatgcccgtaacgttatagatattgcattatcatccggctggaagaatattataataattgacgagaacggacttgatggtgaaaaaatttatggatttccaataattcaagatttatcaaccataaaccccaaatttcaaagatttattgtggcatttggagataataaaaaaaggaaaattatgtttgaatggttaattgaaaaacattttcaacctatcaacctaatttctccaaattcatatatttcacaaaatgcaaaattagggattggaattgtaattgggcatcaatcttacattggaccgagtgtacatatatctgacaacgtaataataaatacaaaagccattattgaacatgaatgtaaaattggatatcacacccatatcgcaattggtgcgatcgtggcaggaaaatgtataataggagatctatgctttattggtgctggaacagtaataagagataatttagagatttcatctctaataactacaggagcaggagctgttgttacaaaaaaccttgaagatcctggtatatatattgggattcctgcaaaagttagactaaatcattaaaaaaaggttgctatttttcagaaaatcttgaatttgatcataaaaaatatttatagcaattaattaggataagtatagaagaacgagatgaattattgatatttatcaatacatttggtggaaaaatgaaactcctacaagacattaaataccctgtttacgaaccaattttctttgggaatgaaaaaaaatatgtaatgaactgtttagatacatcatggatctcttcaaaaggagaatatattaatctttttgagaattcttttgcaaattttatcaacattacctatgccacttcagtatgcaatggaacaatagcattagacttagctttaatggctcttggtatcggcccaggagatgaagtaatagtacctacactcacatatgtagcatctgctaattcaattgtccatgtgggtgctacaccagtttttgttgactcaaaagaatcacattggcagatggacacatcagatgtaattcgaaaaatcacaccgaaaacacgcgcaattatggcagttcacttatatggccatccatgtgatataattgaattgaagaaaatttgcaccgaatatggactatttttaatcgaagattgcgcagaggctatcggaacttattatcaggacaaacatgttggaacatttggtgacattgccactttcagtttttatggaaataaaacaattactacaggcgaaggaggaatggttgtaactaatgacgaggaactttataaaagaagttatcacattaagactcaaggattagttcaagatgcagaatattggcatgatacaataggatataactacaggatgacaaatatttgtgcagctattggactagcacaattagagaatattaacctcattattaggaaaaaaagaaatattgcagaactttataaaaagaatataaaaacattaaatttgccaatacaattccatgaagaaatttacccagctatacactcatattggatgttttcaattatggtttctaaaaaggatgataaagaaaatttacgtttttttttaaaaaataaagggatcgaaacaaggccagttttccatcccatccataaaatgcctatgtacaacaagcgttatgcaaaatttcctgtagcagaatctattagtgaaagaggaatcaatcttcctagctctcccaatttatcagataatgatatttcaactatttgtaatattatacatgaatattataaatctaattgaaatgaattctgtgaaaacttttaactgcagaaagtacatgaaattccattttaaaatggaaaacattaaaattattcaaatttcaaacaaatttaaaaaatcaattatgtgataacatgaaaggacttaaggcattcttatcaatccgttttttaccatatctaaattgggatgaaattttttatttaatttccctaaaattgcaaaaagaaacagattttttttataatggaacaaaattacaatatttttttcattcgtataataatttttatgttacggaaagaaaaattgagattccaataataggggaatatttacaaagattaaaaccatctaatgttcttgaaattggaaacgtgtctagccattattatgattttttcgggacgatttttaatgaaaaaattgatatcgtggataaatatgagaagggatttaatgttattaacatagatattgctaattattcaacaaataagaaatatgactttattttttcaatttcaacatttgaacatatggatgatgattatgagcaaattcatggtttaaatattgacaaggaaagatgtatcgctgttaaaaatatggagtatgttattcaaaatttattattagaggggggcacttttattgtcacttttccttttggtcaaagtcctaaattagatcatttttttaaatcgagaaaaattgaaaaaaattgcctgtaaaaagatttgtaatgcagtaatgatacgcgatcagaactataattggaaacaagtggtttttaaaaatctagattatctagatcctgtagatgaaaaaggagctaaaagtttaatcgtgttagaattttcaaaatgaggtacgtaatttgttaatattctgcacaaatagagaactaaaaaatctaattattttcaaaaacactacttataggtttaatttgaaaactagaggtattttccctagattattttgtaatgattttacaatgacttttttttattttggatactattcgtgatattactacatgaaaaataaagattatttatatcataagaaaaagtttttaatcggccaattgggttcttttggcgattgcttatatgcaaccacaattgcacgtcagttaaaaaatgattaccctgactcatatatcacatgggcgattggaaccatataccgctcaataatagataataatccctatatagatgatatttgggaatacccaatctcaaatagggatgaattgttaagttgttgggaaaatttccaaaaagaagcgtggataagaaaaaataagggagattatgatgaaatatttctaacacaggtatttccaggaaatattaaatattttgatggtacgctacgatccgcaatttttcgcgcatataataaaccaataacagtccctcttgcgccagttgtgcaattatatgaaagcgaaattaaaaatgttcatgcattcgcacaatctcataaattagagaactttaaaactgttatcctctttgaatgctcaccaaaaagtggccaatcttttgttacatgggattttgcatataacgttgcaagcaatattacacacaaacacaaagatttatgcataattctttcctctaatgaagcatttcattcaaataataagcaaattattgacggaagcgtattatcttttcgtgaaaatgctgaattaacaaaattctgctctcttttaattggttgttcaagtggtatttcatggctttgtacttcagaatatgcaaaaccattacccatgattcaattaataaagaaagaaacatcaatgtatgcatcttttatttatgatcatgagtatcatgggattcaatctgacatgattattgagatgtcagaatgtactccatcaacattaatagactgtattgaaatgattttttctcaaaattttgcattatctcgattaaaatatcatcaaaaaattccattagactttaaatactatgcaactgtaatttcacttgaattattacaaaaaagaaaatataaagacgcattattatccttaaagtttacaataaaaagatatggcttaaaaataaatttattaactagctttatcaaagttatatgtaaatcaaaatggttgcagaacaatctaataaataaattgggattaaaacacctatgagttaaaaattaatactgaaaaatttgaatacataatatgacttctattttagatttcatataggtttaaatgtagaataaatttctcaaaacttcaatatgaaagtaggcatctttactggtgatcacaatcaagaagaaactgggattggtaactatatttgtaatttaattaatgaatttaaaacttttcaaattgatttatcaattattcgacatccaaaagggtatagctataatataaaaaatcaaattatcccatatacaatctcatcaactggaatgatggtctggtcttgtgctgtttcattccagaaatatttgtttaaggatctggaccttgttcacagcccgacactggcattattccccattaaaccacatgaaaactatgttttaacggttcatgacatcatatttaaaaaattcccccaatttattcccaaaggaacggtaagacatacaaaattatttttttctcataatctctctattgccgataaaatattagcagattcacattcaacaaaaagagatcttattgagatatatcatgtaccaaacgataaaattgaagtaatcccagcggctgcagatcgtatctatagacaattatctgaaagtgatatcagaaaaataattcataaatataatttatttaaaccatttattctctatgtaggaacgattgaaccgagaaaaaatatttcaaaaatactagaatctttctcatactgcataaaatggtttcctgatcttgaattggtgattgtagggaaaaagggatggtattaccaagaggtctttcagcgtttgaatcaacttcacattcaggaaaaggtacgatttttgggatacgtccctctgactgatcttccaggcctgtataatgccgcagaactctttatatatatctcacaatatgagggatttggaatacccccacttgaggccatgcaatgtggtacaccagttattgcctctaatacatcttcccttccagaaataataggagatggcggggttatgatagacccaagtgatcctataactttagcaaatgagataaaaaaaatcttatctgataatcatttcagtgaagaactatcatattatggcctagaaagatcaaaacatttttcctggaaaaaaactgcagacatgacctatggagtatacgaagaaattatgtgtaaatagaattttgactgaatatttaatagcaaattattcgatttattcattgaactgattggttaaatattaccctagaggaaatctaatttttttcataatgcgataattatgtgccaatagagatttaagaattaattaaaatcctaggaatttttcaagactattatgaatacaaaaggtgaaaaatgtcatcattaaaacctattggagcaataacaggaaaccttaagcaaaaccaaactggaatggcaaattatgcattcaatatccttcagggcctgtcagccaattataagattactcaaattgctgatcatacgggtgatattattaggggttgtcagtgcattcatccaaaaaatccgcccattcctttcaactatctcatttggagtttatctgcgtctcttcaaaagaagttattttctcaatttgatcttattcataatatgtgtcaataccctgtatatcccccaaaaaataaaaaatatataattaccatttttgatctcataccaatattatttccagagttagtaacaccagtgtatgcctggcaatctcggaaccttcttcccagagtactagaaagatcggacaaaatacttgcaatttcagaacatactaaaagagatcttattattagatatcaaattcctccagataaaattgatgtaactcatttaggtgtttctaatcattttaggccttatgatcacgatttgattcaacaatataagttaaaaaaatctttgttaaacccatatatattatttgtgggtgcactagaacctaaaaaaaatattcctaacctgataaaatctttttggatgtgtctgaaaaaaaaacctgatttaaatttagttctagctgggaaaccatcatggaaatatgatgagatattttcattaattcattcattaaaattagaaaaaaaaatcagagtattaaattttattccatacgaagaactccccttattatacaatggagcagaagtttttgttttcccttcaaaatatgagggatttggacttcccccacttgaatctatgaaatgtggaactccagtaattgtatctaacagatcctcacttccagaaattgtgggtgaaaatggattgatggtaaatcctgataatgttctagaattaaaaaacctcatattaaaaattatagaaaacccagattatcgaaggaaattaaaagaatattatatgaaacaagcggaaaaattcacttgggaaaaatgtattcaaaaaaccatccaatcctacgaaagtatattaatgaaatgacaaaattaaccttttaaaagtgggaaaaaagatattctaatattctttttgagcgatataaatcatattccgagccattataccatatttgcctggcaatttaaatttaatatcatataaattatccacaagcttttcaaacctccatagaggtttaaccagagaatcaaaaaatggtatgaaaaagttattgcctattatctcaatgattttataattatgtaattcaaacatttttttcattttggatacagacataagagagatatgctgctcaaattgatctggaaataatccattcggggttgtgacaaccatatacccacctggtttaagcaacctatcccaggcaataaatgcctcattcggagaagggagatgctcaataacttctccagcatatacaatatcccatttgccagttaatgctggcttttgtgcattatccacaataaatgtgattggatgcgtattggatatcgccggatcaatatcaaaggcagtgatttcaggacattcttcaggtgagagaaattcacgaaaaatacatgaaccacacccaatatccaatatttttgtatccttttctatctgtaatttatttataaaaatatcacgtagaacattaagccgaaaattatggtagttttttgcccagaccgaatatgtatcgcagatagtgccaactccttcccacattgtttgtttacataaatattaatattggtgatttttcaacatcagacttaagtatatacaccatttcacttctccatgctaaccttacctttttcccatctaccatcaaataataattaatcaatgacaaaaaccgcattcatcaccggtatcaccgggcaggatggttcctatctcgccgaattactcctttcaaaaggctacgaggtccacgggcttgtccgccgggcctcaaccttcaacacccaccgaattgaccacatatacgtcgatgcccatgatcctgatgcacgaattttcttccattatggtgatctctccgactctgagatgatctcacatgtcctctataatatcaaaccagatgagatctaccacctcggtgcacaaagccacgtcagagtcagctttgaaacccctgaatataccgggaatgtaaccgcccttggaacaacaaggattcttgaagccatcaggagaagtaacccggctatccgtttctaccaggcatcatccagcgagatgtttggacatattgctccaccacagaacgaagagagttgtttctggcccagaagtccctatgcttgcgccaaactctatgcatactggatgaccaggaattatcgggacggctataacatgttcacctgcaatggcatcctctttaaccacgaatcaccccgaagaggtgaaatatttgtcaccaggaagattacccgaggtattgcagcaatccttgccggaaaagagaaatatctttaccttggaaaccttgaggcgaaacgtgactggggattcactccagaatatgtagaatgtatgtggcagattctccagcaggatactccggatgactatgtcatcggaaccggtgagacccatacagtacaggagtttgtagatgcagcctttgcctatgcaggtctggaccccgagaagcatgtaaaaattgatcagaaatatttcagaccgacagaagttgaagcactccttgctgacccgtcacgagcagagaagaaactcgggtggaaggcaaagatcaaattctctgaactggtgaagatcatggttgatgcagatatgaaagcagcaggattatcaccggtaggagaagggtatgagatacttgataagaaattcccaggcagatggtggggcagggattgatcctcttctctatttatacaaccattcttaccaacacaatttacaaataagcccgtgatgaaaacaggatttatcaaaattacagaaaactcattaataactgcaccagtagcaacgagggtcggttctgaatgatttcgattcatttttattcattgccgtaaataccaagaagtatatatttataggaattatgacaaaccactttaatagacataaaattaacataggaaacatttccacctataacaaaatcttcttcaaaaagaaggaaaatgttttcgatttcttgaaaaaaattgattttgcagatttatttttatacacaggcactacacttttaaatttctttgctcttcttttcatttttacacaaatatttttttactgtaatatcacagttaattattttaccataattatttcatttatctgttcattcttggtaccattcctatccatattttatcgatctactcatattatttccaaaactgaaagaataaaactatcattgctttatgcagcaaaaataatcagtatttgtgcaatattaattattatttctataatgcttggatctgccttcattgatgatggatatgattcgaatgcatatcataaaccatactcattatttttcattcatggatggaacccgataactggctcaacaccagacgtttttggtggaaagatcatcgtcggtgatcataaaggaaatacctatccaaaagcagttgagttaattgcgtcatacatttatttatgcacaaaatcattagaatcagttaaagcagtaaattttataattttttttgctagcttgactataacatattcagctttttctctcttttttttgaaaagaaaatatattgctttaattatttctatactagcagtttcaaatccaatttggttaatgcaatccacacaattttacaatgatggattcgtttcagaactctttttaatattaatctcattaattttgcttttcatcaaaggaaatgctcaaaaatacacactattatctctgctactcggattaacattattattgagtagtaagggttcagctcttctttttgttccaattctcataactcttttaggcacactcacgtatttatataaaaaagaaagtttcagatattttccggcaatattattaattctcggatttttattttgtattactgcatattctccatacatttcgaattatatcactacaaaatcaccgctaggatcagagttttcgaaaactactccagaatcctatacaaaagaatatacagggttttcgaatgacaatttacctggctggatggttccaagagcattatttttattatctctgttttcttctccctcacaatcatatacaggattaaataatccatttgaagtctcattagctgatacctttagcatgaccggagaagataaaattaatggttttggtcctctgataggccttatcacccttataacagtaatcggactattattcataataaggacaatccaatcagaggatgaaagaatattactgatttcgatattttttatctttttatcagttattcttcatactgcatgttggtgggcaaggatggtacctcaattttatttaatacctgtttttgtcctcgcaattacattattgaaaaaaagtagcgtaataaaagtcatatctgcgttattggttattcttttgctcataaatatgatccttattagttatcattcatatacgcgtgcttcttatattactgatcattacgaagatgctttttcacacataaaaagcaatgctgcattaccagtgggtctgaaaaatacttttccagataattcatttaatcttgtcagtccggttagtgcagttttacttgatgaaaaaggcatcccatgggaattatgtgatccgaaaaatggatgtccagaggggggttacagaaattctctattattttttacagacgtttattattatccaaaatcaaattgagtttcaaatactgattttataatcatttcagaggctgatgcataaatcaattttggcaatacagagggtgttgcacaactcagatccccccataattttttaactaaggtcaatcaaaagtactttaccttagtacgtccaacatatactcaatgtataatacgataggtcgggattttgaacaactttaccttctccctgaggatattagagactggggtccgagtgatgctttctttcatatactaattgatttaatctcagtgcgacaagaagcagtaaatcggattgcgaacccggtttaaaatcgggaacgccacccaatccattctgggcgtccctacctgcacgtgcgtgtttagcaataaacgggtgcgaagctgcaggaacaacgtggtgattcccatagtctctttgggataagctgccagggaaaggtatcatggacaaacaaacgttgaaccgctgcaggatcgttaattatatcaggaggaaagagatttgcccctgtccccactgagggagaatcacggtatcagtagcttgaattatgctggtacgaatggacgaagctgattccggtctatgggcgggtcctaaaataccacaattatccgatttattgaacttggaaaacccaatacgctcctaaaaaaaaaaaaaaaaatttttttaggtaagaaccttgtgagaggaaccacatgcgtagtgggagtaggaggctgcaaaacgcgaatgcccggctgtaatggctgtggataggggttcaaactttgccctgacctgaaagggtgccgacgtgcagctggtttttcacggcgaacaggatggtttcaatgaacgggataagttcaattacgcataaaagcgaggacatctcggacagaaaacttgcaaaacaatggaagaaatttccatttgctaaagcaagagattatgtaaagcgacttcagacacgtatcgcaaaagcagtgaagaacggccaatatcgacttgcaagacgactccagtatctgcttacacattcgttttatgcaaaaatgttggcagtacaacgagtaaccaaaaacagaggtaaaagaagtgcaggagtagatggggaaaaatggaccacccctgaacagaaaatgaaagcagcattaacgctttcggacaagggctatcgggcaaaacctctccggagaatctacatccctaaaccgcaatcgagtaaaatgcgacctctttcgattccaaccatgtatgaccgtgctatgcaagctttgtatgcaatggctcttatgccttgggctgagaccacagcagacaagacatcattcggattccgaatgaagcgaaatgcacaggatgctgcttcatacacttttcagtgcttaagcagaaagacttcaggtcaatggatattagaaggtgatatccgcgggtgcttcgataatttcgcacaccaatggatgcttgataacatccctcttgaccaaagaatccttaaccaattcctgaaagccggttatatttatgatggaatactctaccgtaacaagtcaggtacgccccaaggcggcttaatttcccccttattggctaacatggctcttgacggcatggaaagaatgttgaaagaacactttcccggaaataaggttcatctcatacggtttgcagatgattttctcgtaacggcagactcacaggaaacggcactccagtgcaaggaactcatcactgaatttcttcatgaacgagggcttgaactctctgaggaaaagaccaaaatcgttcatatcaacgaggggttcgatttcctgggctggaatttcagaaaattcaaaggcaaattcctgatacaaccttcgaagaaagctattgccgcaatcattgataaagtaagggtaatcattaagtcggcgaaggcctggaaacaggaagaccttatcaaagccctaaatcccgtaattaagggatgggcaatgtatcaccggacggtttctgcaagtatgacctttgggaaacttgactgggttgtccgaaatatgttgtggagatgggcaaagcgccgtcataataataaagggaagagatggattgccagaaaatactggcacccaacacttaccaaaaaacaggtctttagaacctctactcttactctcgaaaacttctccaacaccaaaattcaataccggaaattcataaaactggatgcaaatccgtttattgataccgagtattttgaacacagaaaaggagttttcctctcaaagcaaagatcgatacggatgttccttcattacgcccataaaagcgggtagtgaaaaacttgagcggattgcggtgaaaatcgcacggtccgttcttggaaggctgggttagggtaacctaacctggctattcgacattctcgacctatccccattatataaggaataccgggaagacggccggggtgcggcaatttatcatccagaaataatgactggtttaatcatttactcatatttcaatggagttcgttcaagccgtcaaatagagaataaatgcagataagatgtaggatttagaatagtaacccgcaattctctcccagaccattccacaatctcgcgatttatcaagaaaaacagttcttttattggacaacttttcattccagtattgactctccttaatgaagcaggattaatcaataacgtccttctcgccttggatggaacaaaactaaaggcgaatgcttcacttggatcgaacatgccatatgaaaagattgagggagaaattcaaaaatatctaaaggaagtccaagaaaaagatgatgtcgaggatcgtctttatggcccggataaatcaggtaacgaggttcccgatgattttaagactcactcaaaaaggataaaacgattcattcaagcaaaagaacgacttgaggctgaacataaggagaaatcccaaaaaaaggaagagaagattgcccaaagggaggaagaggagagagagtctggaaaaaggaaacgaggtagaaaacctaaaaagcctgcaaaaaaccctgatgagcaaagtcttgcaaacactacagatcctgatagttcaataatgaaaagtgggcctggttgtattcaaggatataatggccagataattgtaaaccaggatggctatattctggttccgtttttaagtaattcacccgttgattacagattacttcaaccatgttatgaaagattagaggaaattgctcaattaaccggcttatcgcttgaatatcttaatttacttactgatgctggttattggagctatgaaaactatctgtatatgaaacagcaggatattggatttctctgttctacatgccatgaaccagatattttcagtattagaggcctcgagagaagtttacttgaacttgaacgaatttccgatcaactttttgatggcatttgcagtattccaacgttagcatctattggtgattggtgtacgagaaatctcattcaagatgataatattccaacacccgcttctattgctaaagggattatggaagtgacaatgactccgtatggcgccaaaaagacatattcacaacgaaaaacgattgttgaacccgcatttggatggattaaagaaaatcgcaatttaagaaaattgcagagaaggggaatatcacattgtcaggatgaatggagtttgatttgtttaacacagaatcttcggaaggtctgttcaagaggggagttgaagaaattcagagaactgatcctgcaaaagaagcggcatattatctgtaataagggagtgggtattagaataccttattcaatattgtccgatgcattatcatctttgggcagaatgatcggagacaattttctaaagatgttgataagaaaaagtacttaccaaaaattttccaaattttagtcatgcaacaccctctataatgtcagaatatcatatcattattcacaaaaaacggggattaaccctgtttttctatccaccatgaatacgtctcactaagcccctctatcagtgaatacccgggcttataccccattccatcagatatctttgaaatatctgcacacgaatgcctgacttccccatcacgggcatcaagatatcgaatccccacctttttccctgaaacctccataattgtcctggcaaggtgattaatcgatacactcgcaccagtaccaacattaaagacaccagatacactcttctccattgaaaggattaaagcctgaacgacatccagaacatagacaaaatcccgggtctgttctccatctccaaatatcgtaaacccatcgtcccgggagatggcatccatgaatttggatattacccctgaatagggagaagaaggatcctgtttcggaccatatacattaaaaaaccgtaagcaaaccgaatgaacaccatataaatcagtatacactgcagcgtataattcagaaagacattttccaactgcgtatggcgaaagaggaaccgaagcaaatgtctctttatggggcggaagatagtcatttccatagagggcggcagatgatgcaagtacaattttaggaaccctggcaagtctcgcagcctcgaatacttcaaaaagcccatcaatatttatccggtgatttaatcgaggatcatcaattgaacgctggactgacaccagggcagcaagatggaatatcccgtcaatgccgttacaaagtgaaacaagtcgggaaccatttaaaattgtatcttcaataaactcaacatggtcatcttcaagaaggtcggagatattacacaattttccagaatcaagtgaatcaagaatgatgacccggtcacccctggctgccagtgcctgactgagatgtgaaccgataaagcctgcaccacccgtgacaagatatcgcttactcatacttgtaccaatcccaccatccagtattaattgtattattattcagattagaatacatgtaagtcaggcaggctaatagttctgtgaaattgcagattttattttctccccaaaggataaacattaagatatttaaactgcccctcttatatacaattatggctgagtctgcagtatacagcatcagaattgatccccgtatacgttctcttatggaagagatgaaagacgaagatatacaggcagatattcgatccctgatagaaatatatgtgaaaagaaaaagaaaagagcaacttttgcaaaaggcaacaaaaatatgcagccaaatgagttcaggacccggtgcagtaccaataataagagaggatcgggatggataattcatctgctttctttgataggagttacgcagttaacttttattatagaaagatctatatatattgacaacgcctataatatacgtgcctataacgaagcagccttcagatgtagattatatcaattacctcatcgcagctcgatgcgacgtttcttgtgtaaaagtcgctgattgttattcgacgtctgaattctcgatatcacatgataccttcaatcgattcctaacaagacagtctctaactcctgagacgttgtgggctgaagttgaggcatatgttgacagaaaaaagggctggttggttctggatgacactattctagataaaaaacattccaaaaaaatcgaatgtacatattaccagtggagtggaaaagagcacaaagtaatcaaaggaataggattgattaccttaatttggacagatggaatcacttcatttccaattgattatcgaatttatgataaggatgttgatgataagaccaaaaatgatcatctccaagaaatggccttgacagctttcaaaagaggatttactcctgcctttgtcatgtttgatagttggtattcaggaaatgaaaatttgaagttgattaaccgtcttggatggttttatttcacacgagttaagaaaaatcgtatggtcaatcccgatgcccaaggtaatgttcaagtgtcatcattaaatataccagaggagggattagaagttcatttaaagaaatatggatttattcgtctttttcactcactaaatcgtaaaggtgtaagtagatattgggcaaccaattttttgccgatgaataatgaagataggctggttttacaatctatttgctggacaatcgagaattatcatagggctatcaaagaactatgtggtgtcgaaaaatgccaagctagaaagggaattatccaacgaaatcatattaattgctcacttcgggcatatttacgattcgaagtcaataaatttttgaatggtgttactccgtacgatgctcaatggcaaatcataaaagttggaatttcagaatatattcagaacccaaaatatgcgctataaatttttagaggttgttctgcgtaactcctatttgattcatgtgtcctagcagcagcattctttcaggaggatctgacaagaaaggcacaagagatgctcatgttatacgatcccattacggtggattttgccaggatcgaaataacaaatgttgcctgcaaacggatacttcatgggaaaacaaacccggatatcattcgctctgcactcaatacatctgttgaatttctcaatgatgcatgtttcctgctcaaagcatctgatattattgatgcagcatatgaatgtgcaataactcacaaaattaccgtatatgatgcattatatctcaccgctgctatgaaagaagagaaaattttcatcacagcagattatgccttgtataaagcagctcatgatgttcatgagattgttttgctcaccacatgaaggataaggtgtaaaaagggagttttaatctctcggataacggttcttatcccctctcccaattccctcatacacaaatcccgcccggatgatcacatcagggtcaacaatattcctcccatcaaccaaaacaggaaaaggtctcatcattctctttacccagtcataatccagtgcataatacatccggtgagccgtcataaggacaagaacatctgcatccttcaccaccggttcaatatcagatgacagactgaaaccaggatactcatgaacccatggatcatgaatctctgtgactgctccatgtatctgacagatattaacaaactgttctgtcggagtatttcgtgcatcatcagtattgggaagaaatgaaaatccaagtatagcaatcctggagccggagacctcttttccaacacatgaaaggccttgtctaaccagatgaaacgtatgacggggcataaagtcattcacatgccgggccaggacaaacagtgattcatgaccctggggataatcaagcggagttctaccagccacgtccaccccacgctccaggtgatatgtatcttttgtcagacaatgcccaccaacacccgctcccggccataaaattgcacgggtgatcccatctccttttagagaatcaatcccggtcctgacatcatagaaatttacccccatcgcctcgcaatataatgctaactgatttgctgctgctatctggagatcccggaaagtattctctgcagtcttggtcacttctgctgcggttgcagtcatcggtatgatctgtcctttcgtgagaaccggttgatataactcgattgcccgacgggtagaatcttcatcaattcctccaacgatccggtcatgctcctgaatattctgaataagccttcctaccatgacacgttccggagcgtgcgccagagcaaaatccctgccggcgagaagccctgactcttcctctaacacctcccttgcccagccacaggtcgttccgggagttatcgtcgattcaaggacaacaagcgtgcctcgggtcagatacctccctgcttgccgcaaaccctcctctagagcggtaagatccggtatcagatcttcagggcttttaaacggagtctgaatcgcgatagttactgcatcacattcttgaatactggtgaagtcatcggtgcagtgaaatactcccttatgcacaacatctgccaacaacttatccagaccaggctcttcgcctttcaagggattttttccttcgttcagcatccggattttataccctgatgtgggtgaatttcgctgaaatccataggcccttcgaataccgggaactgaagcaaagagagcggcagaaggaataccgacatatcccatcccgataacaccgattgtcctgattggccctctttgatttaaggcagcagataattcagttgccatgagaaagcccctggattatgtattcacagacttcaagattcataaccgcctgttcaggagtcacaggaaattctttcccggtccggactgaatccaggaatgacaatagttcgtcacgaagtggctccttcttggtcacctgcactttttctacaatattctcctgaacataccgctcattttctacagaataaaggccgggtttgcgataaatataaacctcctgagtcatgaagtccccttcaatggtaatatcctcctgttcaatgtgaatcatacgtatcttctttgatgctttcctgctggcagagagatagacaggagtattgccacactgacataacgccattgctacatccctggttccccgtgaaaagacctcaaggggatcctggaacaaggagtgaagaattatgtcaatatcatggatcataagatcttcaactactgaactggcagtgatcctggatgatgtcggattatgccttttcagttctacatacagagggcttgagatgattcttgagatttctttcacaataggattaaagcgttcaatatgcccgactccgactatggtcccttttggtatcttatttataagctcatgaccctccgttgaagtaaggcatatcggtttttcaataagcgtgttcattccggttgtgattatcttctgtgctgattgataatgaagaggagtgggaacacagagactgacagcatctacattttttaggagttcctggatagaaccagccacttctgcgttgttctgctctgcaactatccgggcctgatcctggtttacatcatatacgaaaagagactgtactggctttaactcagaatatatccgtacatgattccggcccatcatcccggtcccgataaccccgacatccattattcacatccattgactgcctgagttattgaatctctttgttccagcgtcagtcccggatacaccggaagactaagtatctctcgggatatcttttcagataccgggcatccacatggttgaatcttcccttcatatactggttgtttatgaataggtatcgggtaatgaatggctgctccgatacctttcctgttcagatcggaaacaagctcatcacgagtaatgtcagcctgatcggtaacccggatggcatactgatgatatacatgggttgaatcctgtctgacgaaaggaggtatgatgccgcgacggacaatcttttttgtgaagaaatctgcattctcctgcctggactgattcatttccggaagttttcgaagctgaacacgcccgattgcggcagcaatgtcagtaagtctgaagttatatcctagctctgtatgcagatatttctctttctgaccatgatttatgagcagtcgtatccggttaataaattcgggattggtactggttaccataccgccttctccacaggtcatattcttggtcgggtaaaacgaaaaacagccacaggtcccataacttcccacggccctgcccttatactgtgcgccatgtgcctgtgcacaatcctcgatgaaatggagtgcgtgatcggtacagatgtcagatagtgcacgaatatcacatggctggccaaaaagatggacgccaattatggcttttgtttgtggagagatcagttcaaggaccttttctggatcaatacaatatgttttttcctcaatgtctgcaagaaccggagaggcaccacacatactgacggatgttgcagatgcgatgaaggtaaaggaaggaacaatgacctcatcacctggccctataccaagtgctgccatcgccatatgaagtgccgttgtcccgttgcttgtggcaactgcatgaggggtcccacaaaaatctgcaaattctttctcgaaatgaatgacttcctgtccggatgcgagcataccagaaaaaatcaccctggctgctgcatctgcttcttcctgaccaacaaagggacgggctacagggatcatttctgaatcgctccctcaggaagtggtttgatccgagcaggtgaaccaatcgcaagcgagaatgggggaacatctttggttacaaccgacgctgctgcaataagggccccctctccgatggttacacccggtagtatcgtagcatttgcacctattgaagcatgatcacgaacgattggaccgaataggttctttcccccatgagggggatatttatcatttgtcagaactgcgttcggccctataaaaacataattcccaagttctgaattggtcggtacatacaccatactctgaagattgacatggttcccaatggtgcagtttccttctatgattactccggttccaagagagacatgattccccagtaccgttttttcccggacgaggacgttatgaccggttgagaaattggatccggtccggacatcagcatacagaatggtgccggatcgaatgatggcattatctccgattataacaccaggatgattcttctttccaatataatcccgggaaggaaaaccgagcgtaaccggatcaaagatttgtacattttttccaagctgattattgccatattcgaacacgatattcacataattatacaattggagaatgaataaaacgagcacttctgtttaaaatgtatcgtttcactgagtttcccagacaatattgtcatatatatctcctctgatcctccataaataaaccagataatgctatataatatctcgttcaattctctcatcacccaaagcgctcatatcaatagcacaaaaaaatttcgaagtacaattaggtaattaaaaaagttattttttgtaatattgatcatcataaaaatgcagaagcatataaaattaattcaattaattaatgaaaactttacagagaatataaagtttctccgagaatcaaaccgttagatttttatttacatcttcagacatatcatcagtcccgtaaaggggacgtgtacgagtgattacagtctatcagtaacagatttccttccagtatacagtgacaaaatcgtacaggttttaaggaacatcggaggaaccatatggcaaaattttccgacacaatcgatctctatgacgatcagggcaagctgctgaaaagcggtgttgccttggataaagttagcccgctgacaaacgccggcatcaagaagatgatcagccttaccaagagaactgttgcagttaaccttggtggagcagaggcatttctgaagaccggaaaggccggaaagaaccagattcccggacgtgaactcaaccttgaccttgttgccaatgctggtgcaatcaaggaaaagatgttcaagatgctccaggtcaccgagggcgatgacaccgagatcaaggaattcggtggcggtaagctcctgctttgtaccgtcccaactgcacgtattgaagcagcagcaacctacgatgcagcaatgaccgctgtttcagcagcagcaacctatgcagttattgaccagttcaatgttgacatgttcaacggttcaactgtcaaggcagcattctggggtacctacccacagaccatggatccgtctggctcagcttgtgcatccattctgtccattccacagaacaacgaaggtcttggatacgctctccggaacatccaggcaaaccactgtgtcatgatcaccaacaagaatgcaatgcagggtgcagcactctccgcaacctttgaacaggcaggagagttcgagatgggagccgcaatcggaccattcgagcgtgcacagctccttctctacgcctaccagggcctgaacgcgaacaacctggtctacgacctcgtgaagaagaatggtgcaaccggaactatcggtactgttgtccagtcacttgtcgagagagcaatcgaagacaaggtcatcaccccaggaaagaagggaccatccggatacatattctacgagaccaaggacccaatgctctggaacgcctacactgcagccggaactatggcagcaaccatggtaaactgtggtgctggccgatttgcccaggcagtatcctcaaccctgctctacttcaacgacctcattgagcacgagaccggacttccgggttgtgactatggtcgtgtaatgggtgtagcagtcggattctcattcttcagccactcaatctatggtggtggaggtccgggtattttcaacggtaaccacgtcgttacccgtcacgcagccggtgttggtctcccctgtatcgtcgctgcctgtgctcttgatgcaggaacccagatgttcagcccagagagcacctcaaaggtctaccaggatacctttggtaagatcccagagtttgcccagccgattcagcacatcgcccagggagcataatccccaaggtttcgcacaatggctgatgctgaattcccgcaatgcaggatcgtcaccgagcgcctcttaaaacctgaaactgttgagaaaatcctcaataaactggcggtcatacccgggatccgaaggatcgtcattaacggcccgagtataccccagaaagtcccctatggccctgcacggggcctggataacccccattccggaaaagcaacaatccgggtcggggtaacggatgttgacctcagggtgcaggtaggaacattccttctcgaacttgaaacacgggatatcgtctcgcaggtagaggaagcctgtaaggaagtcttcacgaatttttcatactcggtcaaggaaggaaaattcatgaggtcgaccccgacccaggtggactatgcgaagtacggcccgaatgcaaacgaaatcatgttaggtctggtcgatcccaagaataaaaccggaccgacactcatccagggacataaataatgccaatcggacgggtaacacaggttgtagactgccgcgaaagtgcgggtatgggaaaaggaggggcccttgcccaaagggggacgatctccgaatgccgatatcctgacgtcatcatcatagggatgtcccccggtcgccggcatgtcacaaagccggtctgtgatatcacgtctgccctgcgggcacagggggttgaatatagtatcagcaccatgattctcaacgcgggctccgggattccccctgatgccccaaagagtgccggtcatgtgctgggagcatatttcggcctgaatgagaaggaaataatccaggttaaccgccataaagttgcggttctgcaccatggaaatgtcagatcacatatcgtccataaggtcaggtctatcttaaaggactgtgatattccggcggttgtagtctgtcaggcccctgttgattacgaggattttgcaaaggaaggggtgaaaacggcgtttgtgatgcctactgaagagaatgtccggacaaaagggacagttatggcgattgtcagtggtgtcacgaggggtcagaccccgtcacgtgagaagatcagcgaagtcattcacgaagtcatgaaacttatgaaaacttcagatttggagagataaagatatggcatatactccacagtatggtccgggccagtctattgtagccgagaaccggcgcaagcagatgaacccaaatgtaaagctcgaaaaaatccgtaatgttaccgatgaagacatcgttctcatccttggtcaccgggcaccaggtcaggcatacccgactgcacacccgccactcgcagaacagggtgagccggactgtccaatcagaaagattgttaccccgactgacggagcaaaggctggagaccgtgtccggtacatccagttcgctgactccatgttcaatgcaccatctcagccataccagagaacctacaccgaatgttaccgctaccgtggtatcgacccgggaactctgtccggccgtcagatcgtcgagtgccgtgagcgtgaccttgaaaaaatctctgcagacctgattaacaccaacctcttcgacccggcccgtgtcggtattcgtggtgcaaccgtgcatggtcactccctccgtcttgcagaagacggtatgatgtttgatatgctgcagcggtgtatcctcgagggcgggactgtcaagtacgtaaaggaccagattggtactccactcgacaagaaggtcgatgttggtaagccaatggacgatgcctggctgaaggcaaacactacgatgttccactcactcgttggtaccccttaccggagcgacgccgagtacatcgaatatatccagcgtattcactccctgagaacaaagtacggtttcatgccggtggagtaaggaggtactaaatatggcaaaaattgagagagcacagaaacttttcctcaaagcactgaagaccaaattcgagggagacgtcgcagataccaagaccggtttttacaactttggtggtctgaaccagtccccaagaaagaaagagttcatggaggcatccaagaaggtagaacttcgccgtggaatctccatgtacgacccgaaccgctgccacctcggtggtctgccaatgggtcagcgtcagctcatgacctacgaagtttccggaaccggaacctttgtagagggtgacgacctgcactttgtcaacaacccggcaatgcagcagatgtgggatgatatccgtcgtaccatcatcgtcaacatggaccttgcacaccagaccctgcagaagcgtcttggcaaggaaatcaccccggagaccatcaacgagtaccttcacatccttaaccacgcaatgcctggtggagcagttgttcaggaacacatggttgagacccacccaagtgttgtcgatgactgttatgtaaaggtctttaccggagactccgaacttgcagaccagattgagaagcagttcgttctcgatgtcaacaagctcttcccggcaaagcaggcagagcagctgaatgaagctgtcggcaagtcactctggcaggcaattcacatcccgaccatcgtatcccgtacatgtgatggtggaactacctcccggtggtcagccatgcagatcggtatgtccttcattaccgcataccgcatgtgtgccggagaagcagcagtcgctgacctgtcctttgcagcaaagcacgctggtgttatccagatggcaagtcacctcccggcccgtcgtgcccgtggtccaaatgaaccaggaggtatcatgttcggacactttgctgacatgatccaggcaaaccggaagtacccgaatgacccagcaaaggcatcacttgaggttgtcggtgcaggttgtatgctcttcgaccagatctggctcggttcctacatgtctggtggtgtcggatttacccagtatgcaaccgcagcatacaccgacaacatcctcgatgagttcacctactatggtatggactacatcaaggacaagtacaaagtcgactggaagaacccaagcccgaaagacaaggtcaagccaacccaggagatcgtcaacgacattgccggagaggtcaccctcaatgcaatggagcagtacgaacagttcccaaccatgatggaagaccactttggtggttcccagcgtgcaggagttatcgcagcagcatccggtctgtctgtcggtgtcgcaacagcaaactccaacgcaggtctgaacggatggtacctctccatgctcatgcacaaggaaggctggtcacgtctcggattcttcggatacgacctgcaggaccagtgtggttccaccaactcactctctgtcagacctgacgagggttgtatcggtgaataccgtggtccaaactacccgaactacgcaatgaacgtgggtcaccagggagaatacgcagcaattgttgcatcttcccactacaccagaaacgatggtttctgtctgtccccactgatcaagatcaccttcgcagacccatccctgccgttcgactttgccgagccacggaaggagttcgcaaagggtgcaatccgcgagttcgtagcctgcggagagcgtacactcctcatgccagcccgttaatcggggaaaacactttttcttttttttctctgccgtgcgttaaaaaaggtataagagtagagaccttcaggtctgtatcagggaatattgttcatccatactcgttttactgatggaatacgatcaaaatgggtatcttccgtgattatcgtgttaataccctgatgtgacatacaggctgcgtgtatcgcatctcttggtttcattgcgtattgggtcataatagagtgtgctaatttcagaatttcagggctgacatcaatataatgtacatttggtagtgagagaaaatattctgaacattcaagagcgatctcacggttgatctttttcatcagcacgtagacaatttcatcccaggttagagtggaggtacatgcaatgaattcaccctccattatatgagagagggtacttctacaccaacgaccttccggagtatcacttgctactgcataaataaaaaaatttgagtcaatatagttcatattgttttaaatctctcgagaatcatctgttcatggatctcatccgaatcaatatgagtaatataattgtttttagaaagttgcttaaatctttctaatatttcttctttatctggagaaattacaatttttccagattcaatggtaatgattactttttgcccaggcttgaaattagtgttggcaaatattgtttgagggatggttagatcaccattttccctgatgattacttccatataaggtaaatttgtttttctgatatttgagacattggaacatacccataaccaaactaaaatccgcggccttctaaaggccggtccatctctgcgcagatatacgcttttttagtacccaaaacaccttgatggaataatatcgataattaccgtacaagcagtttaactcaaataatcgctccttggtgcgaccgaattaagagattataatctggattttatctttattcactttagtcttggaaaaaatgtgcgtttacatcgaataaagaaacaagaaaatttatacatgtatcttacgaaattaaattaagacttgtaaaacaagaaagtgacatgtaaaaattggagaattacaatgcagacatcagtaacgaaacgcggtcaaaccgttattccagctgcaattcgaaaaaaataccatatcgatgcaggggtccatttggtatggctggatgatggagacaccattcgagtagtcccagtaccgaatgatccattactttctctcaggggatcggggcggggaaaaaactatacaaaaaagttgttagaggaacgaaacatagatcggaaccgcgaaaactccatcaatgaacattgaaaccaatgtctgaagaaatattccatccctaccttctggatacatcagcactcttttcatacatagaggatgaaccaggagctgatacggttgaattagcgttgagggaaaaaactacattcatcccctggacagttctgatggaggtgtattccattaccttgcaggaggatggtattgcagaagcagatcggcgaattgctctaattaaagaacttaatgtaaagattctattgaatatggatgagtcaaccctgcttacagctgcccgattgaaagcggaacataaaatctctttcgctgacgcgataattgccgcattcgcaattcgaaaaaactgcatacttatgcacaaggatcctgagtatgagtctcttcgtggctgggtattaatggaagttttgccatataagaatgtaaataaccaataaccttattcaagaaaaggtaccctggcagatacagcagcagataggaactggtggggggacgctccttccatatataattcagaattgagaggagagactcacattttctcctgaacctgtacttctatactcttaagagaatttcattcccaaaaaaattcctggtttcaagaacgtaataggacaaactatttatttcgcatatgagatcaattatctatatctcatctcacatcaatactcttcgtactggctataacattgattattctgggaagcccctctggtgcagatgtcaacaaaacatactacaacgggtattcgtttgatcccgaacttgttccatccggaatgattccctatcagggtggatggtcgcatggctcactcttttcagctccaaactggctgcttgcccagatagatcaaaatctgatgagtacggtacttgaccggggagtcactccgaccccgactccggtaattggttctgatacatatgatactcatatatcagaggggtttgctgctctcgaagggagtaactatcgtgctgcgtatacagcgtttcaggctgctaccgttctcaaacctgattcatcagatgcatggtatggccttgggattgccctcgaaagccagaaaagattcctgtaagcacttgatgcctacacgaaagccatctcctatgcacaaggagcatcatcaaactgggcttcatatgcaggaaaggggagagttctcttttccttaaaccggtttactgaagcaaaaacagctcttgaaactgcaattgagcaatacgaaaaggcaggagtatcccaccctgatgaactcggggagatatcccgtctccttgaagagttgaaccagagaaatattgttcaaaacccggtaacgatgtcagcatacattcctccggtggtttccggagtataaccaactttttccgcacagggtatccaacctattatgataatatgagaaggaatgggagattctatgagtaattccaaaaaaatcgggataattatctgtgatcgatatcgaacctgtgccgggggtaaatgcctgagatccatgcacaaccgtgaaggagccttcagccggtataagggaatggagattgaactgattggatttgccacctgtaatggatgtccgggaggaaatattgaatatgctccggcagagatgaaaaagaacggtgctgaaataattcaccttgccacgggaatgatagttggataccctccatgtccacgcataaaatatttctcatccttcatcacggaaaaatatggaatcgaagtggtgattggcacacatcccattcctacaagttattacgagacgcattcgcatcttgggacatggaattcagagtcatggaaagatatgctggccccgacccttggtgatgaaaaaaccagggccgattacaattaaaccgcaaccccttttcgtttctcatctaccttttttctctgattataattagagaatccgcattttaagctatatgctcaccggtacaggataattaaaaaattattgcgttgagatacttttatgtatttttactcatatgagtaataatggtgcgatgcatcgtaccaggagtaaaactatgccaagatttgatggtaccggccccattggacggggtcctatgacaggaagaggatttggatactgccgcaccgcataccagcccacacagcagccagtcgcaccttccggagaaaaccagacaggagccaccactgaaaatatccccgtataccagccaccagttcagggtcaggcaccagtatacggactcggtcgtggaggaataccctatggcgggggacgaggatgtgcatctggaggtcctcgaggaagaaggggacgctgtttctggtaaatcaatcctaccagagagatctctgctatctccttacattaacctgatcagaaccctctttttgggaaaagtattctttcagtacatccattatgataataaattgataaattatatttaggtaaaccagataagatgccttatgaatacggtaattcagatagatcaggatctcaaaatatctcttaacgcgataaatgagaaagtgctctttagaccatttgaaaaagtatctctacaggtgatggataatgatacaatagtcattcatcgggaatccgatgaggatccgttcctgaaatccatacgagaacctgcgaattcaaaagaaaaatttacccgaagtgatattgaagcaatgaaaaatgagctctggtcagattgcaggtagtaattgactcgaacatactcatttttgcaaataatgcaacaatgcctgagcagaaagagagtcttgccattatcgaagaaatgattgcttctgataatacattttatgtgaatactatcataatttctgagacgtaccacatactaacccgtatgctgggtaaagaagaagcgatgcaaagaacacaagcaatcttatcctcaaaatatattacatatctccccgtttcttatgaaataatgaataaagccatatgcaccagttgtgataaggaagttcgaataaatgatgcgatcattggcattcaggcattatgcaatgctgatggaatactgacagataatacgaaagacttcaaaaagatagatggattaaacatcattccattgagaaaaaccgaatgaattagagatattaagtaattttttaaaaccatgactcaccacatttttgggccggtcatctcaagacgacttggacgatctcttgggattgacctcatcccctttaagacatgttcatataactgtgcatattgtgaatgcggggcaacaactgatctcacatcacagcgaagagaattttttcctcccgatgagatcattcgccagttggatactgttctctcctcttctccaaaacttgattatatcacgtttgcaggttcaggtgaacccaccctctctctctcccttggtcccgtgctggtatacctgaaaaaaaactacgaacaatataaggtagcggttcttacaaatggaagtctctgcactgacccagcagtgaggcgggatcttctgcctgctgatctcgtgagcccgacgataaccacaaccacacaagagatcttcgagagaatacacagacctgctccgggtctattcgtaaaggagataatccagggcctacagtctttgaggaatgaatattcaggccagatctggcttgaggtttttctggttcccggtcttaacacctcagataatgaactcgaaatgctccggaatgcagtattcagcatcagaccggatcgaatccagttaaattatcttgaccggccaggaactgaatcatgggtatctcctcctgaacctgtactcctcaagaagattcaggaattttttattgaaggagggataccggttgatatcaccgggtttgatgaaataactcctcttcttgctcaggatgatagtattgccctgatagatgaaacactccggcgtcgtccctgtactgctgaagatatcgcacaaatgactggtcttcaagcaccggagatcagaaaaaaactggccctgatggttcagcagggcactgtccaggcaaaaagtggggagcggggaattttttattggatctcctcgaattcctgaaaaaggaacagatcatcagatctgttcaccccttctcattctcccctattatatcccaatcaggataaaacgcatgataccgcccacaaaaaatgcggtcgttgccattacgattactgattttatcattccggagaatccaagctcacgatacagcactgcaaaagccccggcacaggggaagtacatcgtcaacgtggtaaccgctacaaccatctgctgagcggtcatatccaggggaaggagcatacctatagccagatcttttcgtaaaaatccggtcagaagagctccggaagcttcctttggcagcccaagccaaccaacgataaggggagcgagtgctgtcccgagccaggcaaggaatccggttgcatataatatgttgatcaacaggaccccgaggaacagatatggcaccgcttctgcaatgaaagcaacaagacgcatccaggtctttttcatgaccatgttaagccggggggtccggtatgggggtatttcaagaaatatttccggacactcgccatgtatgaatcgactgagaaccatcccgatggtgatatacacaatcacaagcactgcaatgaccagaaggatatacaaaaagccaaactgtccgatagtcccgaatatcatggcagtctttgccatacaggggatagagattgctattaatgttgcagcaatgaaccgttgttttcgtgtttcaagaacccgggttgcaagaatacccggaacattgcacccaagacctaaaaaaaccggaacaataccatacccatgcatccccaaacggtgaaagaaggtatcagtcagggttgcgagccggggcaggtatcctgaatcctcaaggagtgctgcgaggatgtaaaagacaatgacatacgggaggacaatcccgaacggaacataaaggcccgttgtcagaattcccattgactgttcaaaatcaatccctccgtcgaccagttccccaatcaatatctgatgaataaatcccggtccgatgaattcagacacctgggtgatgatcggaagatacagttcgaagagagggtcggtgatatacgttatacaggcctcaccaataaaaattaccgcccataatgagaccagaattaccagtatagcaacagggattccggttaccggtttgatggtgatatcagatatcagatcacgaagagtatggtgacggtgagttatagtctgaacttccctcgtgatctgtccgatcataacccatttttcctcatcgctgtagttcttctgctctgggaccgaagcatcttgtgagaaataggaagcaagctcggcaataccttcgccggtaaccgcaacagtcggaatgaccggtacaccaagcagttcctggagcctggacacgtcaatttcaatgcccgtatgtgcggcttcatcccataaattcaggacaacaagcaggggaacattccttgaaaggagctccagagtaaggatgagatttcgctcaaggtttgtggcatctagaacatttaccacaatatccgcttcattcagaatacgtaatgagacctcctcggcagggtttgttggatccagagaatatgttccgggtgcatcgatgataaacacccgttccctgccaagacatgtcgctccctgtgaataatcaaccgtcgttccgggaaaattggaggtaatcacatgggttccggtcagccgggaaaataccacactcttcccgacattcgggttccccatcagaacaatctttttcaactggtcatctccaccatgatccgacaggccagccctctgccaaggctgatcatcttccggtcaaccttcacaacgatcggtccttgaaagggatgatgtgttaccacagcaatatcttttccttcaaggatgcctattgaacgcagttgattctgcatcccgtggccaccttgtatctcgataatttttgcggtttttccttcctcaagttccattacagatacaaccatgtataccagattccaccatgagtattgaatttagatgatactaatatttttcatgatcacaaataataggctcatcaggataaaataaggtagaagacaacatcgtgaaaagcataaccggaaaaggtcggaaaaccgacctgatgaacatattcttccggttatctcacaggggatttttctttcgagagtatgccgatactggcatttctggtataggaaacagatactacaatcaatgtataacgatcaggcgaacgggttaatgtccggaacactcgtgatcatgttgagtacagatactgccggttgattttaatctccctgcaatataatcctgggctgcgacatctaccggaccgctcacaccaagaattacttcaatattattatcattgaagagctgaactgcccgggcacccatccctccggcgataatcaggttgaccccgtgttctgccagaaagaccggaagccggcccggttcatgcccggggctttgcagagtttctgaatatgcaatgactgaatctgtagcatcatagattgcatatccttcacaatgtccgaaatgtcccgatacattttttccatcacatgctattgcaactttcatgaattatgacctgaatgaattgtcccatcttctgcccattctccgtgaacctccccggggaagtccgccccgaccgatgccataaacaggttctcccagaggagcatcctgctgagtgactggtccggaggaatctggcagattactcacactgttctcaaaattccacctgccccttcgagaaaatttccgttctccaagccatctggggccggtgccatccatatcaggtatcttcgtcacctcctggtgcacagcaccattattactcatatgagttaaaatataaataattttcctgtgggatcatggttcctgcagacggagatcatccggccctttcctgggacatatatgggcatcacggggacagagatattcctggtttttggggcattcattaccgccctgccttacacatccggccacttcaatcatcttgccatgaacaagagcatcagcaaccttccgtctggcatcatgaagatctttccagactgttcttcgagacacaccaagaaacgaagctgcctcttcctgctccattccttcaagatcaatgagccgtatcacctcaatctcttctggaagcaggacaacagcctcaatttcaccaagaacttcgcatctgggaccataacaccgaagcatgccattttcggacatccttctcctgattcttggccttccccgtcttcgttgttgtccctcttcaccattcgccggcatcatatgtggtcaagttcttgagacaggttctgtgtgatctcatgtatcgcttccgatgcagcgccggacatacgggtaaccggaacaccctgcctggttgcattcagaacggtgcggtcaaacggaatcaggccaaggaccaggatttcgttctcagcagcgacctggaggatatcttcggtgatgttctgattaacatcagaccggttgatgacgagaaacatccggacccggaatgaccggcagagggtaatgagcctctggagatctgactgggctgatgtactgggttcggtgacaagtatcgctatctgaataccggtgatggtggagataagagggcagccaattccaggcgggccgtcaatcagaacaagcggcacatccggatgcaataatcctgcttcctgtctcagccggtgaaccagtaatccagaatttcccgaaccaggagtcagtgacccatacagaagtggtcctgcagacgtatccgcataatgaatcatcccggtgatgcgggatttcatgctgacggcatcttcagggcagacaattgtgcaggttccacatccctcacaccggtatggaacaacctcatagatttcaccgaccttttggatagcatcatacacacatgcctctgcacagatgccacaaccaatacatgatttcgtatcgataaccgcaccgtccatccccctgaactcctgggttttgaggtctgttggactgagcagcagggaaaggtttgcagcatcgacatcagcatcaatgaggactttatcctgagagagaagggttgcaagagaggcagtcagtattgtcttcccggtgcctccttttccactgacaacggcgatctgaatcatgaagcccctccggcatatgcaagaattttctcaccaagttccttgaactgttcaaaccaggcgggatctatgcgggaaataaggtcgccattattctgggctttcagcaggggaaaatccaggggaattttcatcaggacaggaagaccacggcctgaacaatactcttcaatatgttcatcactcccttcactccggttgataacaaccacagccgggatattcagaacgtctagcacattgaccgcaacagaaaggtcatgaagcccgaatggtgttggttcagtcacaaggacacagagagagacgtcgtccaccgtttcaataaagggacaggcagttcccggaggggaatccagcaataccagtggatcgtttccggtaatctcacggaccctgtgaataactacggttgtccgcacatcaccctctttcagcttgccactaacaagggtgagcgaatcagaaagatggcaggtttgtacttcaccaacatatgcaggattttcctccagtgcctcatgcggacagacccggaaacatcccccacaggaatgacagagctgggggaagaataatacccggtctttcagcaccgtcagtgccccaaacctgcagaattcaccacatgctccacaatgcatgcattgactttcatttaccttcggaatgatgacatgaacagggtgaatctccggaacacaaggaaagaaaatacctagattgggttcttcaacatcacagtcagcaagagtaatggttcgcgactgtgacataacatatccaagattagatgaaaccgttgtttttccggttccaccttttccactggctataacaatctgcataatatgcccggcagattatacctgcttaagagttgttctctgggttcgctttccatgcattatatgctgcctggaccgtcacatccgggttttgcatgatgactgtgatacctgatgctttcagagcttcatctgcatttccaccaagccgtggtgcaatgagaatctgtacattattttttaccagaaactgtgcagccatcggaccaacgccacctgatcctcctgcgtggggattctgctctactctgactgaatttgtatcagtgtcaaaaaaggcaaaatacggtgcacgaccaaatcgatcatccatctgggagtctgctgttgaaccccgtgaggggatacatactatcataccagataattattgctcatatgtgcaataaatcttcccagataccaatacaaaaatttgaacctcatgacataaatacgtcattccggattgccatatggatggaataccggacaccatattcaaaataatggatgttcatgtggattctatccgagcgagcagcgtgtcaataatagtatctattgatctccaggccgggctttcctttactttccctacgaatgcccatccctcatcaccggatcgacgaatatctatatccaacgggattccccccagatacggaacgcccatctcccgggcaatatcttctcccccgccttttccaaagatatccaccgcttctccacaggaagggcagatatacccgctcatgttttcaacaacaccaagaacttccatccctaaatccctgctaaatgtaatggcttttgatgaatcaagggttgataccgcctgaggggaggtgacaatgatcgttccggtgatatttggtgcaatctgggcgatcgtaagagcctcatcgccggttcccggagggagatccacaataagataatcaagaggttcccaggctgtgtccactaaaaactggcgtatggcgttcgatttcatgggcccccgccagatgacgggagagtttctgtgaggaaggagaaatgccatggatacaacctgaagtttttcagatacccgtaccggcacaattttattgttttcggaaagtaactgatgatcttctaatcccagcatctttggaacattcggaccatgaatatccaggtccaaaaggcctacctgtttgcctcgtatcgcaagggcgtttgcaatatttactgaaacggtggatttccctactccaccctttcctgagagaacgagaattacgtgactggcgtcaatttgtgcacgctccggggattttttttctgcttcagattgcatagagttacctgaaaaaaaggagattgattttacttaatcagaagtcacatctactgatatatcggcgtcgataagaagatcaaagtgcatcttatcaagccagcctgccttttcaaacatgtgcataaagcagatcccaattgcccctgctccgttccattttttcatcaccgatgcaacatcgtctgcggtgaccggcatatttggcatggccagccctcccatgatgacaaggaaggaaggatttttcggtggatatgcctctgatgcctgaaaaccgacatccggttttattgtcagcttctgggctttttcctcttcggtgtaaggcacaaagatacaggtcagagaaagtgaccggatagcaaaacagagtaattcaacaaatggtgtgcaggtaccgggcaccccgtagaacacaatctctgaacctgcaggaagtgaccttttttcaatatagtctttaaagggtcttagaataccggggaccccctgatacgtagtctgtcccataacgctacctcatctctgccggtgtcagcagagtttctgtatgtatataggatcagagtgattctaatatatttcccagcatatgagaaataatatctccattctttctgagagaacagagagggtgtcgctgatatttaaaagcaaaaaataaaccaatggtacaatcatgagaagccggaaatcggatgtgatggtcggtgctcccggcctgtatacctatggagcgatgcggataggaggaataattcgagatgccggatttcacccacagattacccgcaatatttcacaaatacacggtgatcaggtttttctcagcctgtttagtactcttcatctgctggatccagcggtgaaagaggtcgtcaaacgaatacaacagaaagggggggagtgcatcatcggtggtccggtctcttcagggccggagatggtccttggagaactgcatcctgaccttgttgtctgtggtgaaggggaagaggctgtcagatgcattcttgatcggacaggtgatcagacagaccatgctgattgtccaaattgtgcatacattgaagatggtcgggttataaaaaccgaacagaaacgggctcaggatctctccttcccgctccccctcataccggatgatatcgcagcccaggatatcaggggcgcccagacctatatcgaaacccatcggggatgttttggccggtgtgggttctgtcaggtgccacgggtttttggcagacggatacgaagcagggagcttgatgaaatcctgaaggaagtcaaggcatttcagaagaaaggagtcagaaggcttgcccttattggaggtaccggatcattataccggtcaaaggagggtgaagtcaattctgatgcattcatcagcctccttgagggtatttcctcaatcatgggccccaaaaatgtttcatgtccggatatccgggctgactgccttaccgatgaagtgcttgaagcagtcagggcacacaccatcggatggatattttttggcatagaatcggggagtgaaaagatgcttggcctgatgcaaaagggcatacccattgacaaggtccgggatgccattgaacaatgcagacagtacggagtaaaacctgccgggagtttcattaccggatacccgggagaggaagaagaggacttccaggcaacaaaggatctgatggaagaactcactcttgatgatgtgttcatctcaatcgccgaaccaatacccagtactcccctggctgaagttgtttgctctcaaaatccggacatggatctggtatccgtcccgcacaccggcgaatatgccggacttcatctctcagaagcagaggcacgggcatttgatctgatgctgcatgctgacatgtgccggccagtcccccggattactcaggatgtgcactataatgcctaccttgaagaggctagaaaacagggagcggatatcaggaacgtgaccagactgattcggagatattattctgcttaatgcctgtaaatccggaacaaagacatcataggaccattcgggatgaaatcgacgataaacgaacgtcacgcgcataatcatcgattcacgcgtttttttcatccgaatcgtatatatagatcaagaccgtgaactgaagaacaaatactttctctctctgatatgctcaggatcagttgatctgaaaacaatattttttgatttagataagaatcccttgagaaaaaaccttcaatttgccctctttttcccaggaagatgtgtataaccatataaatcgacgttatttcgaaacctttaattcaatactgaccgaacaaatcaattaccacaacgggtctgatatgccatgtgtgtggtattgcaacgcgagcactcttgtgtctgatcttgagctacgcaggagataggtttacatggaagagattgtattaggcattggtattactgcattagcgggagcttttgccacagttgccggtgctgcggaagatactgaatctgatatcggatcacagggtgacccgaactcacaggttcagctcgctccgcagatgggttacattcaccgcatctttaacaaggcaatctccggagagccaccagcatatggagcatggtgtgccatcggagcaggtgttgcctgggcattgatgcagattaactacaacccggcacttgctattattctcggttcagttatcgccgtatttgtacagggaatctactgtacttccggttatcttggccgtatagcaagtcttgcaaagttccagcagccggtatacattgacatcatcaagtcattgttatcggtcactatggcacatgcgttcgtcgcgatcttttgtacggtcgcgatgtgttacctgatggcatcagcactccatcatccgttcgcactccccctgctcggactggtgtggggtattgcgcttggtgccgcaggatctgcaaccggaaatccattctacggaaaagaacgtcagtaccagaatcagaagtatggtgcaggtgttccgatctccgcatctggaaacatcgtccgatatgcagaagcaggacagcgttcctcccttgacaatggctggttcaccaccaagtttgccggtccggcatctggtatctgtttcggtctgattgtcttcctcgaactctggcgtaccgtcctctttgagaagatgatgggcggatggggagcaatcatcatgggagttgttctgattcttgtcttcacattcatcgaccgctgggttgaagtgtggggccgcaagacctacggaccatacaccaccgaggaggcctcgtcatgagtgcactcggaggtaaggcagccggcggtgaagggataaacccaaccggatctgtcgttggtatagttattctcctcgtctcgatcgctgcaacatacgcacttggtttctctatcgttcctcttatcggaataataatcggtggagcactcattggatttggcgttcactttgtgccagtcggtggtgctccggcagcaatgggacaggcacccggtatcgctaccggtgtcgctatgcttgccgctggtgccggtcttgcaggtctcttcggtggggcctgggcatatgaggcaaccggggactttgcagtagcagtcgctggtggagccgtcggtggaggtcttatgatggccatcacctgtctgatggtcaacgccacctatgtcttcgcaatgggtatccctgcagcatctggtaagattgccaaggatccaatcaccggagacaccttccctgaatataaatcacagggaactgaaggacatggtctgccattcatctcattcttcggaggagttgttggtggatttatcgccggtcttggcggaaccctgatttacatcgaacttctcgatgtctaccatacaggactgccagcaattatgcaggccaatccggaagcaatcgaacctctggcagtatcactcgccggaatctttgctatcggattcttcctggtaaacgcagtactggcagcatataacatcaccggaactatcgaaggaccgcatgaccccaaattcaagcgtgttccacgggcaattatcggttgtgcagtcgcatcagccttttgtggcctgatttcgatgctgattgtattaaacacggggatgtgagggatacaacatgacagcaaaaatggaagcttcagcaggggcgatatctgaaaacaccctgatgatctacggaattgtcgtcgccttagtcggcacatacctcacatatctcaatgttgtaactggcatggccgttttctccttctttggtgggatcggtgccattgcagcaatctggtggggttctgacacaatcaagcacctgtgcagttatggtcttggtactggtgttccgtctgccggaatggtagcattcggagctggtgcaatagccatgattgcagggacaaaatttggaatagcatcaccgattgtaacactgatccttgcagccattattggagcagtgatcgggtacatcgcaaacaacgtcattaacatgaacattccggttatgatcttttcactcatgaaattatcaatcgtcggagcgctgaccatgctcggatttgccgctatgtgcaccggcaccttcatgttcaatggtcttgttatcggtgggatgactctctccatggaaccagcaggagaagctgcagccggaggagcccagacattcatggtaaccgtattacctgaatttgcagggtcactcatcggtggatcagctcttgcagtgatcttcttccttggtgcaatggctctgcagcacccgttcaatgcctgtcttggcccgaacgagtcacaggacagaacccttatgctcgccatcgaagtcggattcctttccatgttcgttgtagccgttatatcctatgcattccttgacatgatggccgcaactgttggattgataatctcactgattgggtggatatacacctacaagcagtacattgcactgtccaagcgtgatgcatatgcatggcttgatgcaaagccaatcattgaagtcggaggtcatgagtaatgacgtggattccggttcttcctgacttcggtcttggatgtgatgtatttgcaggattcgtcacccagcagggtgagtctctggcaccaatcgtagaacaggtgaacaagctggagaaagtcactgacgatattgttggtatgctctccggtgagggtagtttccttgagagcttcccgaaccgtgagaagtcactggtattcgctggtggaatcacggccatgttctatggacttgctgtaggactcctggtcgccggaatcatcgttctggctttgatgtgaggggagaaaaatggcaaacaagaaatcaccagccagtggatggccaattgtccagggtgacttccataccggtgacccaaacagcccggtggcagttgttaccatgggatcccacctcgatgaaggtgcaatctgcagtgcaggagcagccatcgccggatcctgtaaaactgaaaacctcggtctggagaaagtcattgcaaatgtcatctccaacccgaacatcaggtttgtcataacctgcggtactgaggttaagggacacctctccggtcagagtcttatcgcacttcaccagaacggtgtagacggcggaaaaatcgttggatcaaagggagcaattccgttcatcgagaacctttccgctgacaacatcaaacggttccaggaacaggtcgaattagtcgacatcatggaatccgaagatctcggagcaatttcagcaaagatcaaggaactgactgcccgcgatccaggtgcattcgacgctgaagccatgatcgttgagatcaaggaagaaggtggcggagcagcagaagagggtggcgaagtcagaccaatgtctgccgaagtcgctctgattcatgcacggatgaaaacaatccagcggacgattaccgatattggtttctacgacaagtacgctgccggtgtatacggtggtaaagtcgaaggacttatgatcggtcttatcgtctcgtttgtgattataggactcctgcttgtaggacacggggtgagttaagtgtcagatgagaagaagtcagggccaatacgtatggctgcaattgatgccatgatggccgacatgaaatacaagggacagatccttgcacgtaccaacaagcttgaatccggtatcatgggtgcaggaattatcggatttgcaatcggtcttgcatttgcccttatcctggttgtgcccgtaattctgatgggaggagtctgatggcagacaagggagaggccgcctccggatggccaattgtccagggtgacttccacaccggtgactcaaagagcccggtcgcagttgttaccatgggttcccaccttgacgaaggtgcaatctgcagtgcaggagcagctattgctggatcctgtaagactgaaaacctcggtctggagaaggtcattgcaaacgtcatctccaacccgaatatccggtttgtaattacctgtggaacagaagtcaagggtcacctttccggacagagcttaatcgcccttcaccagaatggtgtagacggcggtaaaatcgtcggatcaaaaggagcaattccgttcatcgagaacctcaccggagatcacattaagaggttccaggaacaggtcgagatcgttgacatcatggagtctgaggatatcggagcaatttcagcaaagatcaatgagctgaaagcacgggatcccggagtcttccctggtggaccaatggttgtcgagatcaaggaggagggtggaggcggtggagcagccgcatctgcaactgcaaacccgcagttccttgagatcgaggctaagctggacgcaatcgaaagcaaactcgaatttgtcgagggtgagattgcccagcgtgtcggccggaaagtcggacgcgatattggtatactctacggtgtcgtagccggacttatgtcatacatcataataacggaattacttccgaaactgctcgagatactcgcaaaataagaggtgataagccatgttcatgtttgaaaaggaacagacggtccttgatttcaatggatacaagatcggaggacagccgggagaatatccacgtgtcctcggtgcatcgatattctacaacaaacacgagaccgtgctcgatgagcacactggaaagattgataaagcaaaagcagaggcactctggaaccgttgtcttgaactctacgacgcaaccggtcactggtacttctgtcagatcatcgctgaattcggagaagccttcgagagctacatcgactggttctgtaccatcgatgaccagttcccattcctgatggactcctctgcaccggcagcattggcacatgcctgtaaatatgtgactgaagcaggctgtgcagaccgtgcagtctacaactccatcaacggttccatcggaccggagaacatcgaggcaatcaagaaaagtgatgtggatgcagcaattgtgctggcattcaacccaggtgacccaagtgtccgtgggcgtgagaaagtgctcgcagaaggtggcgttgccggtcaggagaagtccatgatggcaattgcagaggaatgtggaatcaagcgtccaatcctcgacactgcagcaactccgctcggccttggttccggtggttcattccgtgagatccttgcctgtaaggcaatccacggtctcccaaccggtggcgcataccacaacatgaccgtatcctggacctggctcaagcgctggagaaagagcggtatccttgaacgatacaaagacgcaggaaccctccttgaacagatgggacaccaccactttggcggtgttgaaggtatccgtcaggctgcctggtcctctgctgacatcggttgtaacattatggcagcaacccttggtgctgaccttatcatgttcggtccaatcgagaactgtgaggcaaccgcaactgcaatggcattcagtgacattgttcttgcagagaccctccgtgaactcggtggggatgtaaagatagataagcacccaatcaacatgctggtttaaaccagctttattttttgcctcccaatttagtgccaatttcggtcttttcttgcaatcgaaaaagtacttctggatcctttagagatcgtggactgtccataccataagacggccattatagtatcaaatattaaatttgattcgaaatattcgcactctgtcacggaagtcagaagaataaatgagagatctgacaataccatgcgtatatgtgaccctatagaatgcccatattttgagaactgtatttagtgtaggttcagggtaggttatgtaagtcgctaataaaatcccccaatggtacccatcctaaaaataaaaaataaaaagaagatatctatttcaagggtttcaaggggggatccgtaacttgtatgcctgcatcagcaatttttttccgaatcatatcagcgatttcgaactgttttgaggcacgtaattctgccctgatatcctgaaggatactgagcggagcactggtttcggggaggaaccgaatgccaaggatctctccatattcaattaacgcttcgagatcaccatgtgctgcaagggcatggattgctgcaatagcattcggcgtattgagatcagattccatagctgcgataaatgcatcccgtccttcaggatagggaccattgtcggttattgcgatagcacggatgtgttccagggctttttttgcattgaggagaccttcttcggatacctggagcggtgagcggtagtgggagaggagaataaagtacctgatgatatctttgtcccatgttttgagagcatcctgaattttgatgaaatttcccagggattttgacatcttttccccctcaacggtcaaaaatccggtatgcatccagtacctgaccatcggatgtttcccctcaagtgattccatctgggctatctcggcttcatggtgggggaagataagatccagcccgccgccatggatatcatactgctggccgaaatatttctcagtaatggcagtatcctcaatatgccagcccggacggcctcttccccacggagagtcccaggtatattcaccatattctccccgcttccataatacaaaatctgcaggattgtgttttttggtgtcagtaacccggctgattcgtttatcctttgattgcccggataattccccgtttctgggaaatgaatcaatgttaaagtagacaccggtttctgtgatatatccaacaccaatccccaccagtcgctctatctggttgatgatttccgggatgtgggttgttgcccgggcgtgataactcaccgaatcaatgccaagtgagagcatatcttttatgtattcacgctcaaacttccttgcaagatctttttgtgaaattttctcttcttgtgcccggttgatgattttatcatcgacatcggttatattctggatatacagtacctcctgcccggtccaacggagatactttgccagtacatcaaagaccacataggtccgtgcatgaccaagatgcggataattgtataccgtcggaccacagacaaagagcgaaacccgatcaggatagagtgtctggaatggctcgaccattctggataaggtactatacagttgcatattgaaatcacccagcagaaacgccggcggagggaatcgaacccccaaacattcgctttgcaggcgaaggcattcagccactctgccacaccggcatcagaagactcatcttacagatacagacacatcaggtggataataatcctcatgcggagagaggagtcaaccacgctgatcggtgcagatactttcctgcagattctgtccatactatcgtatgccagattcatttaaatatatcaagaatcaggcaaaataaaccggataatggaagagatgaacacagaatatccgtataaaaatggtacctcatgaatatcaaggcaaatattggagggtaagaatcttaaccagtaatgtgaatccccatcattcttattgccgaatgtagtcgttttatatacttttacgtcgacctacattaacgcaggtgagatatcctgtggtgattgccaagatggcggagcggccacgcggctgactgcagatcagctacactccggttcaaatccggatcttggcttttttccagttcaactatctgatcagattcagataggatctgaactctataaccactgataaggagcagactgcactctgctcctgcatatatctgttcaattcactcccccctgaaaaagagaaaaggatatgccagatctggcaaggaatcataccaggtctcaatggtggcaagaagattatctatctcattgctgatgattataagtttgttgagtttgaacccttcattgcagagttccccagaatctgtgcaggcacttgagtgtctgaactttagagtgattctgataatgcgatcctgaaacgattcagaaccaaaaaagatctattgaagggatccagtattactaataccacccgggacaccacttgcaatacattttacaggcttcttcactcgcataataattctggtcataccccaccctcgagcactctcccatacaccatgcgcaccccgtatcccacgtgtcaacgcattgattaaatctattcgttggtgtaggatcaaaaatttcaagatataatccagtattttttactttttctccggtattcatgatgggttccggactgctattagcaaagacatttaatcccgaaccctcgtagaactcgagtggatgcaccttaagcgtaagaatcttcttttcatcagataatgaaagattctctaccgaaatcattgagatgtgctctttatcttctccggatatgaccagtgctgcctgcaaggggtatgaaaagtaagaaaaattcggaattggaatcaattcacccgtattttcctgattaatataacagtacggaacaacacccttgatggttatcatactcgttccattcggatctgaaataatgtcactttctccaccctgaacatatatcgtaaaaccagacggtgaatctgccagacttgctccggtcagagataccaacaaaacaagacataggcatccacataatggaaaagatttcatacattccttctggaaataaagcagttaaatcttttaatattgaatcatcaaccagaattctctcatttctaatcagtaggagaaaacgctgactcttcatcatctgaatcttcatctgcttcacaccatccaaaatgaatacacgagatgcaggaggtgttcacggagtgaagacacccatctggatatggctctggtttgcaggagggatcataaagcgggttgtcaacctcctgaaaacttccatcctgcatatggtggtagttatagggatctttcttcatgatgtaatccagattaagcatacaatacccctcgatggtaaggatggcatactccgagatacatgggtattcttcgtcaccagattccataatcagttcgtcgtttcttccgatacaaagtttctgactatgccagggagttcaggagaagtccagatgtcccttcattccagataatttttcatatacttcgcagaattcttcaagtcccatttttagatcatcctgaataatcttttgaaggacccttttggaacatcttaaccgctatgaacgggaacgaccattaatcccatcgaattcgattgaattagagttgtaagtatgatcactgtacaaactcaaatccaaaatagaatagtgcagacatacctttgacacattgcaatgaataagaagaatcggaggtgaataatcacctctcatcgcttctaccccattacaaccgcctggtctgattctgaaatgctatagatgctttgacgtgcatccatgaaacttaatcgttccttcagcattgcattcatcttgagccttcggattgcataccgaacagttcttggcgggagccttgtcttttctataattgctttctgagtgagaggttcaccagtctcaagcactttatacaccagcttcgcagatggtggaagacgctcaaattccaatacttctaaatttccagccccttcagaggcaaaaacgatcccttctggtcatagtgactacacatagatatgatcttatacctaataaacattcacaatggtgaattgaatgccctgaaaataaaataatcatacataaaagattgccattcttcaaaaaaaaattcagttcttaactggcttaccagattaacctcaacaaaagtatatgcaaactctgccggtttcctatctcttttattactgggtacctaatctgtatgagttcacatttgtgaaaattattatttaatgaaaaggtgattatccggagatggagaaaaagacagacgaggtttttgatgccctctttaaactggaagaaataaggcagatactccgtgactctctcccgaccggacttgataatgacgagaaggaggcctggaagagtaaactatccgagctgaatgaaatcgttcaaaaactggattctgaatcggtcacgagaccactcaaaaaaattgcagggaccattgagatacgaagccgggaagagaactatatcaatattcagccaatccaggcagcaggacgattaacgcttgaagcccggaaggcgattattgcgtacggagatggctactcaacctgtgatacctgccgaaaaccattccgactggacaagatctcaaaaccacctatcggcgattttcatacagaacttgccagatttgtgaacatggatcaggcacgggtggttcctggagccaggcggggatttcaggcagttgcacagaccatggttcagaggggtgactcagtcattgtttcatcgtttgcccactacactgagtttctagccgtagaaggagccggaggtcaggtgcgggaagtccctgttgataaaaataatctcataaccgctgatgcaaccgcgacaaagatcgaggatgtcattcgggaaaccggtaaaaatccagcactggtcatgatggatcatatcgactaccaggtggcaaatgaacatgatgtaaccggcattgcaaaagttgcccatcaatacgatatccccttcctctataatggagcatatacggtaggaatcatgcccgttgatggaaaagccatcggggcagatttcgtggtgggatccggacataaaagtatggcatccccggcaccgtcaggcatgctcgcaacaaccgatgaatgggcaccaaaagtgctgagaaccactcagatggttggggatctgaccagcagaaaattcggggttaaggaagttgagatgctcggatgtaccctgatgggttccaatcttatcgccatgatggcctccttcccggaggtacagaaacgaacacaaaactgggatgatgaagtgaaaaagtcgaattacttcatcgatgctctcctcactatcgaagggagcagggtattgtcagagtacccgagaaaacatgccttatcaaaggtagataccacgggaagctttgacatcgtcgcaaaaacgcacaaacgcaagggattttacttctctgatgaattatccgctcggggcatagttggggagtttgcaggagctacacggacctggaaactatcaacatatgggctttcgtggaagaaagtacaatatcttgctgatgcgtttaccgaaattgcagaaaaatatgaattaccactaaaaagtaaaacgtgagaacaatgaccgataaaaaagacagagatagcaccacttctttgcatgcaggtcagagagcggatccggcaaccggatcacggacggttccgatttatcagacgacctcctatgtatttcgtgatgcagaccatgcagcagcgctttttgggctttctgaactcgggaatatctatacccggctcatgaatcctacttccgatgtacttgagcagcggattgcagcccttgaaggaggaagcggagcattagcggttgcatccgggcaggcagcaataacctatgccctgctgagcattaccaggcttggcgatgaaatcgttgcagcaaacaatctgtacggtggcacgtataccttgctcaaatacacctttgcgaaacttggacgaaccgtcatctttgttgattcacaggatcccgaggctttcagaaaggcaattactccaaaaacgagagccatatatgcagaaaccctgggaaatccaaaactggacgttcctgactttcgaactatcgcggatattgcacatgaagcaggaattcctctgatcgttgacaatacctctgcagtcggactggtaaagcctatcgagcatggtgcagatatcgttgttcattctgctacgaaattcataggcggtcatggaaactcaatcggtggactgattgtggattcaggaaagttcaattgggggaatgggaaattcccggaattttcagagccggaccccagttatcatggcctcgtatactgggacgttttcaaagattttgccggtcttggaaacgtggcattcatctttaagatcagactttccctgcttcgggatatgggagctgcaatatcacccttcaactcatttctgctccttcagggattcgagacactgccactccgtatcagacagcattcagaaaacggccttgctgttgcaaaattcctgaaagctcatccaaaagtcgcatgggtaaactacccgggtcttccggataatccggcatatgaactggcaacaaaatacttaaaaggcggatatggtgcccttcttggatttggtgtgaaaggcggtgttgaggaagggaagaaagtcattaacgcattacaactcttctctcatgtcgcaaatatcggagattcaaagagtctggtcatccaccctgcttcaaccactcaccagcagctcagtccagagcagcagctggcaaccggtgtaaccccagactatatccggctctcaatcggaatagaaaatgttgaagatatcattgaggatctggatcaggcattagcacagatctaagcttctgtgaaatgggaaatcttcccattcatttcggaagcaataccagatctgatgcaactcatttcactatgaggaataaccgataatgaatccagatcttctcaggtgaaccatcatggcaagaatatacagtgacattaccaagacaataggaaatactcccctcatccgactaaaccggataccgaaagcattagaaacactcccaaaccctccgacaatcctggtaaaacaggagtccagaaaccccctcggaagtgtaaaatgccggataggagtagcccttatcgaggatgctgagttaaaggggcttatcaaagaagggacgacgataattgaacccaccagtggaaacaccggaatcgctctggcctatgtctgtgctgcaaagggttacaaactggttctaacgatgccagaatcgttcagtgtggagagacggaaattattggtcgcattaggagcagaacttatcctgacccctgcatcagaagggattcccggggcagtcagaagggccgaggagattcatcgggaacatcctgacagttacctgataccgcagcaatttaagaatgaggcaaatccgaagatccatatgcgaaccaccgctgaagagatctggaacgataccgatggagcagtggatatcgttgtagcgggggcaggaacaggagggaccattaccggaattgcaactgtaatcaaagagcgaaaaccttcattcaaggctatcgttgtggaggctgctgaatcaccggtgatctctggtggaaagcccgggccccataagatacagggtatcagtccgggatttattccagagaacctgcatgtaaacatcctggatgaagtcatcccaatcaccagtgaagaagcatacgagatggcacgacgacttgcaaaagaggaagggattcttgcaggtccctcttcaggagctgccctcgcggcttccctgaaagttgcagccaggcctgaaaatgcgggaaaattgattgtgacaattctgccggataccggagaacggtacctgtcaaccgatttatttccctattccgggtaattaatctattttttcatatctttcgcattaaaaaatagagagtcacctggttgtcccacatatcgggcattgaggatcctttttaatagaaacttcgtgaaaggtcatgaatttcccatcatagagaagtaatcgatgtgtaaccggccgtccgattcctgtgatgagtttaatcgtttccgtcacctgtagattcccgatgaccccgggtgttgctcccaggaccgggaagatttcttttggaggggcttcatgcaccagacatgagagacagggtgtttttccgggaattattgtcatcatctgacctccaagtccccatactgaaccatgcacaaagggaatcgagtgaagatgggctgctttattgaggaggaaccgggtcggataattatccatggcatcgacaatgacatcggcatcctttgtcagctcatacacatttctgtcatcaatagttacatccagagcagtaatcctgacctcaggatttaaccttctgagtttcgcaactccacttacaacctttttctgaccaatattctcatcccagtggagaatctggcggctcaggttggacggatctaccacatccatgtcaaccagaataatatgtcctactccggctacggcaagatatatggcaataggactcccgagacctccggcaccagcaacgaagacagtagcagattttaaccgttcctgcccttccaaaccaaatccggatatgagcatctgccggtgatatcgtttttcatcataatctgtaagaaccattctctcacgttcatattggattgctcattgttacatacaccaggattgaggcaattattgctgctaagtgagagatgcatggttggctgttaaacataccatatgatggcggatgttgccgcaaagagacatgatttatgtttaatcaccattttcataacaactaattcattgatgtattgcaagatggcgaagcggccatgcggctgattgaagaacaccacacgcaggattatccggatatcggcttaaaatctgacaatatcacacataatttcaggtattgggatttaggccaattttattcgatattcacttacgtattcaggaagtcacacccggaaagatatatgaaacctgacatctggcttatccgatattctgaaatatttttgaaaagcgaacctgttcgtcgtgtatgggaggatctccttatccaaacactcaaacaaaaattaccggattgtagcatatcaaaaacacggggaaggatatggataaccggtgatgtagatcctgaagcaatcgctcatactttcggggtgtattccttttctccgtgtatcatgttccccttgtcagatctcaatgaaagagttctcacatatgtaaaagaaaccggtttctctgcatacaaaacgtttgcattacggattaaccgctcagggacacacccttttacatcacaggatctggcccgaacactcggagcatccatccaaaaatcatggccatctattgctgttgacctcaccaatccggaatatgaattacatattgaggtccgggatgaacagtgctacctgtatcaggagatcatatccggtcccgggggaattccgcagggagcatcaggcactcttgtcgccctgcattccggaggaattgactcgccggttgccatgtacatgatgatgaaacgggggacgatacttcacccggtatacgtgaaaatcgctccatttcatgatgatagttctgaagaacgggcacatctgattgtagaacatttgaggaaatatcagccggatctaacccttgaggtcattgatgatgggcatgtgtacgctaccaggatggaactgaaaaaacgggaccttgaaaagtatgcctgtgttctctgcaaacggcacctgtaccggatcgccgagcaaaaagcacgcgcaatcggggcaaaagggattgtcaccggtgagtcactggcacaggtagcttctcagacccttgataacttgtacgtcctggatgatgcggtctcaatgccggtatatcgtcccctcattggatttgataaagaagagaccatagcagtcgcaaaaaaaatcgggacatatgatctatcagtcatgcaggttcccagctgttgctgtgccattccctttaagccggcgaccacatcccagcgggaaacgatatctacccttgaagaggaactagcaaaaggatctccagccaaataaggaatggaatattcggtgcatattatggacataaatataaaaatacaggatttgaaaagcataatcaaagaacatgcaccacttctcatcgcatactccggcggagttgacagtaccctacttgcggttcttaccagggagacaatcggagcagagcatatgcattgtgtactggtggacggaccggaagtaccccggagagcagtgacagcagcaataaaccaatcagaatacctgaaaatccctctcaccgtccgggaaggagtgccattctcccgtgatttacaaaaaactaacccacatgaccgttgcaggcattgtaaactgggaacctatacgatcctcaaacaaattgctgacgataccggctgcacgtatatcgcagatggtgcgaatgcatctgacttaggagaacatcgtccagggattgaagcgttcagttcatgtggtgttattcacccatttatcatggcagggatcaccaaacaggatatcagggatattgccaaaagcatggatcttccattctgggataaaccatcttcagcctgtctttattcccggatcccatacggagaagagattaccgatgaaaaactgcgtatgatagaaaagggagaggaactgctctctgacatcggaatcagacaggcgagggtcaggcatcatggattaattgtacgaatagaggtgctacctgaagagatggagaagatcctgattcaaaaagatacagtacacacgttttttcaaaatctcgggtttttatatgtcaccctggatctgaaaggataccgttcaggaagtatggatgaggttctcaagctctcatcctgaatagtcaaaatgctctactccggaaatttctgtcgattataggtagtcagaaggttttctataaattcttcggcggatttcaaatccgaactctggaaggtagtataaaagatagagtcttcagacatacctttcagagtaaaccaatcttcttttcggaaagtaaacattaaaagccctcctaattctctcttgtctatttttccgagcgtttccaggatagcaatgaagggcttgtctaccggatcactcaaggtatattcatagatactagatccatcagtacattttgaggttcgtttcttttttacaacatgcataaatggcacctggcattttatggataaagaattgaaagaaaatgttcacaatactgaccaggtatcatatatcatcacaggactattcaaaattcccatgcgtgaattgtgattatcatattgataatgaagagatagaggatttttaccggaagagcctcctccatcttcttccataagattcaggtaatattattgatattgaggacggaggtgattgtaagggtttaataaccggggcgtggtacgagttatacgaggatgcagatctcaataagggtgacaaaaccccctgccaaagcattatgagatataattattcaacagtatattccacgacgaagttcccggggataggagtactgtggataccatatacccgaagaactccggattttttttactgaaccggaatggttcaggtcaattccattctcgtttgtatgaggcatactctttcctcatgttcaattcatgaatacatacaagtataccgctgaggtaataaataatcgaaaaccggcagaatataccacatcatcccataaaaataagaggattaaatcatttcaaagacttctttaccctcctgacagagcgggcagagccagtcatctgggagatcatcaaaggcagtacctggttcaataccattatccggatctcctttagcgggatcatatacatatccgcatatcgagcactcatatgaatccatttcgtttactcctttatcttctgtgttttatataccaatagcagggcatcagcatatttctcagtcatcttcgtcgggatgtagttgagcacttttgctcgtttcaccagttcattcctgatatcactgtcacttcccagatgaagagctgcgacctcatcgataataaagtcaagctggtttattcccgtcggctttccatccaccagaatagagccgatattcgtgtcctgagggacaatacccccacagaccttgcaatacacgccatccttctcgtcactcatgattcattctcccggatcatcgtcagggacatcttgaacctggttacagcgctcagggcgtgcggaatcccggccgggaagattatcgtatctccttccttcatctggtacgtcacaccctgaacccatacctcacattcaccgtcaagaatggtgacaactgcatcaaacggtgcggtgtgttcagataacccttcgtcctcgtcaaatgaaaagagggtaatggatcctgccttcgtatttacgatcatccggctggctaccgttccattctggtaatcgacaagatctttgagggtcaatacttttccacgaagctcgtcacgcttcttacggcttttatccactttttccaaggtatctgcattaaattccatgatcttcaccaggggagaataatgaaggtactgacgttcggccacttattcgtttcagccaggaggaatcggagcatgataattatccgcattcctttcgatgaacgatattgaccgtagccgttattgatatcaggccagagccatccgcttcatgtcctcttcgacagtgctgttctttctgatattgaagttttcaaccaggacgtttagtactcccggagagacaaagccgggcagtttcggaccgagagtgatgttctttatcccgagggagagtagagcaaggaggacaagaacggccttctgttcataccaggcaatattgaagaccacaggcagttcgttgataccaaccccgaatgcctctgccagggccttggcgatgaccaccagtgagtagcagtcattacactgaccggcgtcaatcacccgggggataccaccgatatcacccagatccagagaattataccggtactttgcacacccggcagtcaggataaccgtgtcctttggcagggcctgtgcaaaatccgtataatactgacgctcagactgacgcccgtcacatccagccatcaccacgaacttcttgatatctcccttctttacggcatcaattaccgttccggcaagggcaagaacggcttcatgagcacagccagtgatgagatcacgaccgttggttttggccggctctgggggctggcatttcttagcatggtcgatgatggcagagaagtccttggatccgtctgccttcttcgggatgtatgtgatacccggataccctgccggaccggttgtgtatacccggcctatatatgaatccctgggaggaacgatacagttcgttgtaaccaggatcggaccatgaaaggtatcaaactcttccttctgatgccaccaggatgatccgtagttcccgatcaaatgcgtgtacttcttgaatgccgggtatgcatgtgcaggcagcatctctccatgcgtgtagatatcaaccccactgtccttggactgctcgaggagctgctccatgtcacgaaggtcatgtccggtgataagaataccgggatttgttccaaccgtagtcttcaccgacgttatctccggatctccataggtcttcgtgttcgcggtatcaagcagggcaagtgtctgaacgcctatctccccgcattcgagcaccatggcgatcattgcatcaacaggaatatcctgcagggttgatgccagacctttctgcatataatcagttattgcctcgtcggtaaatccgagcatctctgcatggtgataatatgcagcaactccctttaggccaaagacaaccagagcccggagtgaatgcacatcatcatttacattggctagttctgcaatttctctcgcctttgcagcaatgtcagcatcactcttcggggtccagatgcaggcatcaggctcgttctctccggctttcgggagggcatcccggatggcgatggcctgggtgataagcgctttaagccgttcatcatcaaaattcgtattcgtcaaggtggcaaagagtgcttcggtaatgaatacccctgcgtctttgttttctgctcccttcgccctggcggctatgttgcgaactgaaatccccttacaaaggtagatgagcacatcctgcaatcctgcagtatgatcttcctttccacagatccctttcaccgtacacccggtcccccgggcagtctcttcacactggtaacaaaacatgggtatcgttctcctgtatcgaaatgctacaaactatcaattgtatatcaacttattaataggtgcgagtttcagaaagtatactgtgcatgagatctgtacagtcaacatgaccgtgaaatacctgcttaaaaaatggaccctccttatcatcttggaactgtataagggtcagaattatacccgcaggttttctgaattaaaagaggccctctctgatatcaccccgaagatcctgtctgaacggctcaaagaactcgaagatgaaggtattatcacaaagaaagtagatgcaacatcgtttccagtcaggtgtgaatacaccctgacagagagtggtgcagaccttatcgaagtaatccgtgatatcaaacgatgggccctgaaatggaagatagacaatatcccctgtggtgaacaggattgcaggaactgtgtcctctaatccccccggagggatcgtttcattggaaaggaatacgtgaagatgatgattctggatacatgtccgggagtaaaggacctgaagactcccacactaacaataaagaaatgtccgaaatgtggagaggaagtcgagattttctctaatgacacccaggtttcgtgtgagacctgtggatttgtcatctacaatgacacgctctcctgtattcagtggtgtaattatgcaaaagaatgtgtcggagaagagatgtataatgcatttcatcaaaaaaagggaggcagataattgatcgttactctcctgacttcacatcatgcaggcattagggagtgacaccaaaatcataggatataccggttgaaaggtaatatccaaaaggaaacttcctcctttttgtacctataaattgcatataccatagaagggggcataattcctgtgccatgcgccccaggagagggaggacacatgaagcgaaaaataatttctattgacgaagacgcctgcaccggctgcggtcagtgtatccctgactgtccggaaggagcacttcaggtaattgaaggaaaggcacgtctcatttcagatcttttttgtgatggtctgggcgcctgtatcggtacatgtccggaaggggccatccgggtgatcgagcgggaggcagagtcatatgatgaaagagcagtcatgcagaatatcatcaagcagggacccgcagttatcgctgctcatctggaccatctgcgatcccatggcgagcatgaactctatcatcaggccattgcttacctacaggaccagaagattcagataccggaccataatacgcaacacggtcctcatcatgggaatagggcaggatgtccgggggctgcgatgcacaccattccacgacctcatgagaaaaaaggcacacaagcagatgcgcgggcagagtcagaactgcagcaatggccggttcaactccggctgatacatcctcatgcatcgtattttgataatgccgaccttcttatcgcagcagattgtgttccgtttgcatatgctgattttcatcgcgattttctgaaaggaaagatccttctcatattctgtccgaaacttgatgcggacattgacaaatatatcgataaacttgcagagatattcagattacacgcaattcattcagtgactatcgtgcacatggaagtcccctgctgcagcggagtcacctctgtcgtaaaccaggcaatacatctttcagagcaaaagataccggttgaggagataaccatcactatcaacgggaacgtaaagtgagtttccctgatttacaaaactataacaaaagatgagatccctcggtaaaaagggcaagtgccatctgaatgggaacttccgggcatcaaaggacaagaatggcttttttttatactcatgatatatcacgaatcaggcggaaggttttctccctcccgacaggtagtactcagtagttcatgatggtcaacaagataaagattcacaatcgtgaaactatttattcttgcgagtcagataaatacccatgaaatttcctgctctccttctggtggcatttctcctctcctctcagatctggatagcaggcgggctacaacccacagtatctatccagcgaacaaattgctgcatgaattcaccgtgttcagaagcatccggacagacagcttctggtacgggacattgttcctgcaattccatgcccgcttcgatggcccagaatgcatgttcctgcatgcatcatcggatgatgacatccgctccgggtgtactcgaacgggtcagaacgtttgttgtcagagggtatcgaaaaatcactaagaaaaatgttcttgatcatcctgctcgaaaacttctctatgacctgatacgagataaccccggacttgagcgaaaagatctggtaaaactgagcggattgaatgaacatacgatcaaatatcacttagaacagattcagagtgcaggtcagatctctgtttgccttgcaggaaataacaggcattattttgagaatcatggaacatattcatcccaggagcaacagttattttcccggtgtcatcaggatggaccggggcgtatcatacgggtagtccgggaaaacccgggaataaaccggggggatgttgcaaaagaactgggagtatcaggcccggtgatatcgaggagcattcttcccctgatacaggcaggcatcatcaggcaggaggcagatggaaaatacaggagatattacccaggatgggatgcacaaaccatcactcataatctcaattcctgacatttttttcttcatgtagctcttctgattagaacaggtatatattcacaattccaatgctaacaatagcggacggagatggatgaaaaaccccattttcatccgaatcatccttcgtactacaggaggaatgaattatgaaaaaatgtatgaaatatgcaacattcgctatatttttaatcctttgtctgacaggaatcgctttcgcagaaacgattgagcagaaagattcgaatcaggtacagatagggaccattctggaagatccagaaacctatgtgggacaaaacgtcacctttaatggaacaatctcatcacaatgtggatcaggatgctggtttatcatatctgacgatacgggagatctgtatgtaaccctgcgggccaacaattttgtgatccccccggctatgggtaaaaaagccacggtaataggccaggtttccatgaaaggtgatgtctatgtaaccgggagccaggtcattatcggggataccacctatccatgaatcttttcatttttgctctccggaacctacagcgccggaggatacgaaccatccttactatggccggaatcgctctggctgtggcggtcctgttttccttactggcattccaggctggatatgaacaggaacttatgaaggatgtggacagcctcggaattcatatgctcgcagtcccgaaaggatgcccctatgaagcagccagcctcatcatgcatggaggagttatccccaagtatctgaatgagtcagacctcttactggtaaaaaatactgaaggagtatccctcgccaccccgatgcttctccatcagttcatggtaaacggatctccccacattctctatgggatcgtgggatcagaaatgcggtccatacgaccatactggaagattgaagggagattcttcgaagatagcgagcagaaggtgatggttgtcggaaaaggacttgctgaaaaagaagaactaaaagtcggacagatgcttccctttgggccaaaaaaagagccgttcgagatcatcgggatactggatgcatccggaggacaggaggatgagttccattttgttccactcgatgaagcacagcgggtatttagaaaagaggggcaacttactacgatagccgtcctcgccgatgatatcggaagttccgggatggtagcggatagaattgaagagatccccgatatgcaggtggtcacgatgacccagattaccggcacaatcctcaatatcgtcgggtctgcccggacactcctgctctcaatgattgtcgtaaccctcgtgatcaccgcatttggaatcaccaataccttgctcatgtcggttcatgaacggacaaaagaattcgggatgctcaaagcaattggtgcccgatctcatgatatcatcaggctggttatattagagacattggttgtaaccttcctcgggggtgtagcgggagttcttcttgccttgcttggaggagggattattgaatccttcatcagggaaaacgtcccttatgctccttcaggtagtctgattgcagcagatccggttatggcactcctctgtatcggactatcagtcatacttggactggtatgcagtatgtatccggcgattcgctctgccagacaatcacctatggaagccatgaggagtgaaatatcatgaccgttatcgcagtttctgatcttgccaaggtgtacaaacgtggtgccgaagaggtgcatgcactccggggagtcagtctcagcgtgaatgccggagaatttgtatcgatagtcgggccttccggatccggaaagactgcactcctcaacctgctgggctgtcttgatacaccaaccggcggaattatctccatcaacggaaccgatgtcacgacgcttcctgaaagccggcgtgtcctgatcaggagagaacagataggatttgtgttccagcagttctttctcatcccgaccctgaatgcaaaggagaatatcctcctcccgttaacattcagtaaaaagcaggttgatgaatcaagagcacgggagattttggagatggtgggactatcacatagggagaatcatcttccccatgaactctccggcggcgagatgcaacgggtggccattggaagggcattgatcaatgatccaaagatcattctcgctgatgagcctaccggcaatcttgacagtcacaccgctgaacaaatgtatgggatatttgaggaactggtggaaagagggtatacggttataattgttactcacaataccgagctagcccatcgggcacaccgggtaattcgtctgcgggatgggcatttagagccggatgaaccctgtgtttgtcaggataatacctgaccagatcctttccttttctttataaccgaatctgcccagcaaaaaacttggaggaaatgaaagaaagaaggtgagttaaaagtcagcaaagggagtcagatcacatcccgtgcagggaagacacatcgtttttgcatgaaggggggatataccatacctgctcatttcagcttttgcatgataaccaagacggagcaggcggtctgctgatggtctttctgcgcccggaattggacaggacgggtgaatcactaccgggcgaagaaccgggatgacgcctaaagacgcaagttctgaaacaccggagacgaccgtttgatcatcttccccaagaccgatgatcatattggaactcacatgattttttccaaatatacgagccgcatctttcagcgcattcagaatataatccaggttttgatcaggacatatggcagggaagagagctcggtccatggtttcaacattatattttacctcatcagcccccgctgcatacatccgttcggaactgtcatgtgtcggatacaaagaaaccccgatgggaacatcatactcttttcgaagtattttaacaatcccttccatcctggtgacttcatgttcaggcgagatctcaataccggtggtgagagaaatcgcctgaaggaaccctcgtgaattgacttcatggataaggctgaaaacctcttctggtgacttcactggtccctggatttgatggaccggacagaatgcacaccggaatatacaccgctctgaaacggtgatatatgcctgatgaggacaatgggcaccaacaggttctatgaagccccgagcaataaaaaatccctcatgctcgataataactccatccccatccgatctcattaaaatagggctgttatcccgaattgatagtcgtacccggcgcgagtcagcagaaaagaagacagatcttcctccggcacccggacctgcagtggatctccctacatactcaggacgttccagggcgggatccagcctgactgagccgatactgattaattttgcttttatttctgcagtaaatgaatcatccatacctttcacctgaaactcaaggcccctctcatatcactttcgagatgagagattggtatgttgccatataaggtaagaatcaggaatgcggcaaatcatgccggaacctctttcaatctacattgtcgtgcgaaaagaaaaaaaagaatttcagcagggtttttttagggagccatatattcttgtggagtgtcaccaggctcaatatcattattttttatcttttggaccagtatgtcaaagttctgtatgatattatcctgaccggtaagatagcgatcccccatcaggacaaatggtacatgaacatgaccaagagatttttgcaattgagcaaatttttgtgcactggagttgtctgaacctatattataataggctacagagatatctgatgaattggattcatactgctcaataaatggatgcactacattacatgacccacaggatggatcatagtaatattctacctgaatttttttcacattctgatcctgagtacctgcatctattccattgctggtccccgatagaacggtaacaagccctccaaaaaccagtaaaagtgctacaatcaccgatatcagtaaataatttctattgatactcatattctctccataggtatagtacaatctggttataatcacgaatttaaaggttctctcatcaaaggagctacatgagtatcatacccgtatgtttgagtatgagcgaaaacctctcaataatcagcaaaatttaaaaatagagaaggagtatcaggcaccagaccaggtaaatattttccagtggcctgattttttcgcaaattttctctgttttcggcttgtttttaccgaatttggatgtgacagatgctgatatacaaggattcccccgataagtcctgcaatgaggacaagggaggtggagatatccccatgagcaatatctgcaatgtcatacaccagtatatgacggattacttctgcaattcctgcaaggaatagtacttcaactacgaccttatgtgtcctgaaaaagacctcaatagtttcaagaagcgcaatagcggttgcggcgtggaaaaatgcactataaatctctgatgaagagcttgagagtgtttcagtctgaatagcatgaatcgtgcttaatatcccttcataaaggagaaatgcagcggtgattcccagaatacctgcgcttaccacgtagagaagtactggtattgatgatatgatggtgccgattttttgatgatatacagttgttttcatgattcgttcctgttgtaagggatccattgaccaggatcagggtaatcaaaagatgatgcgatgcaccgctgtgcaaatttttcgagaattgtgaatttaacaacaggaacgcattatacctaaacggaatagtcctgccggtacctctgacagatacgtattccgagagaccggtttatgcctgatatatgtcatatcttttcattccgaatagtgttcacgataacgtgaaccttataaccgtttcgtcaccgaataaaaataatctgattttcaggcaaaagatgccagtatttttcgtaatccgaaggagaaaaaccattatatcaggttttttcagctttccataagatgaaacagatgggatgccgttgtcaggataccctgcattccaaacagttattccaaaccccaagtcactctgcacgatagtttatctctgtgccgacgtaataaacaaacaagagataagaatacgcaaattgaggagctgaaagacctctcatggagcctgaaattaccgacatggttcttctttttcagactgtcatacaatggattgcaataatactatctgcctccaccggtgtgtatgatgcacggaaaaacgggatggactattttggtgctcttgtcatagcagtgatagtagcagtcggtggtggaacgatccgggatctgttgctcgacaggtaccctctcttctggctggcagatccaatttatcttatcagcatcttcatcgtggggataattggaattattctcattccaatatcaagaactgatcttcccggggatcagaaacattcttctgggtttttacaatcgattgtcagactgatctttggaacttcagggacctttgcctttattgattcgttcgctcttggtatgtgggcataccttggcaccatgtatgcacttaccagtggaataccacccattattgcccccatcatgggagtaatcaccgcttctttcggaggggtgctacgagatatattgtttgcaaaaattcctgaactctttaaaccaagccagttctatgctatagcatcttttgctggtgcaacggcatatgtgctgatgtccatggaagggttttcaagtactgatggatttatcgtatgtatgatagtcaccgtttttgtgcgtatgacatcaatacggtacaatattaccagtttttaatttgaaaggcctatacacctatgaaaaggaatagatgtggatgatcacttttcatccagattcccttggaccaaatcaacaataatttttcctcattcacacctcacaaccagtcgggataaccgttctgcagtaattataccaacaacccggttttcttcatcaaccacaggcagggcggatatccggtttttttgcatacggtttactgctttactgatatgttctcctggtgttgcagtaaggacggtcctggtcatgatatcttcaagagttttcacatcctgcgccactgaccgggagatatcccaggaagtaacgatgccgacaagtctgccatctgacgaaacaatcggaaggtgattcactgcttcagcaatcatcagagcagctgcacctttaatggtcacggtctcacgaaccgttggcacactccggatcatcagatctgaaacagttaggtgcgagagaaaacgccccagaaggtaattcatctgtcctgactccagtaggaatgcatcatgcccgtaattggatcgaatctcacagtattcaacagttttatccagctgggccagggcggatacaatctcccgtgagagatatgatggatataaccagtctgaactgacggcgatcaccatgcattttgctttcatatccttaaacgcatcaatcagtgagccattcaccgttagatcaaaataatcgactgcttttgtaaggtacagatacgaatttgcatcaaatcgctcaacaaaccgatctccctggtgatgaagataactctctacttggaagtctgtcgtaaaatcataactataaacagattttcccagtaaatccctgccaaatttctgatgcatcgattcatctgaaaggtatgtgatatgaccgatcatccgtgccagtgcaagacctgaggctggatactcctgatcataatactggccattattccaggatggatctgaacgaatcgcacacctaccgacttcattgaaggctatctgctgtggcgttgaatacgcagtacttgctattacaaccacccggctcaccatatccggatacgaaacgctccactgcagtgcctgcattccacccatagagcctccggcaacagcaaagagatttgtgattccaagatgatctatcagttttttctggaccatcaccatatcggcaatcgtaataaccgggaatgatactccgtataccttcccggtttcaggattgaccgatgaagggccagttgtccctttgcatccacccaggacatttgaacagatgatacagaaccgatctgtatcaaaagcttttcctggaccaataaccatctcccaccatccgggcttttcatctccttcatgatacccagcggcatgggcatcaccagtcagagcatggcagataagaattgcatttgaacgctccgggttgagcgagccatatgtttcatacgcaaccgtaactgaagggagaacagctccgctttcaagcattaatggtgaagagaatgtgtgaacctgagtgtgtacagttccaactgaaccacgaatcataataccatcctatctccttgaaaggtcatccccggcagtaaaaaacaggaatgatatccagcgatattgttcattttacccctcatttccgaataattataccgggcccactcttcttcatctgtcggcacgggatatttttctttcttcctgatatctggagcattcgttcaagagctccacgtgccgtataaatcagagatttttccagagtaacttctccagcaccagacaggagtgaatcttttacagcatccagggttgtctgtttcatgggggtgcagatccccccgacagcataaaatcgcttttcaggaatttcacgctttaaacgttcgatcataccattttcagtcccgatgataaaagtttctgcaggatgatcctggcagtatgcaatcattccacttgttgaacagactgcatcggcgatatcaattacttcgggtctgcattccggatgggcaataaatggggcattccaatgaaatgctcgcatattatctaccattatcggtgtaatccgatcatggacataacaattccctcttccgggaatgattaatttatctgaaaaccgctggacgtaggaggccagattttgatccggaagaaaaataacctgatctgatgcacatgaacggactatctcaatggcattcgccgatgtgcagcagatatctgacagagctttcgtggatgccgaggtgttgacatacgacacaacgtcggcatccgggtactgctctttcaaagaaaaaatatcagattcagataccatatgtgccataggacactgagtgtcttctgccggaaggtatactcttgcatccggagagagaatttttgccgtctctgccataaaatcaacaccacaaaaaatgatacattcggcccgggcatcacgggcggcaagtgataactcaagggaatctccaatcttatctgctatatcatagatttcaggcctttgataattgtgtgccagaataattgcatctttttctctttttaaggcggtaatatcctctttgagagattggatttcagattctgtatgtcgaatatatgtcatttccctattttcacaattgtgaaatatgttggatgccatatatcataaatactcttgaccagtatagatccatatactgggatcctaaaatagtgcaaataaggacacgtttagagagatatgaatatacagacgattcgggaagatataccgctcactcgggatcttatttattttgataatgcatctaccagcctgatgccatcatcagtaacgcggattatggaggattatgagacttcattcagatcaaatgtaggaagaggggttcaccgtctctcccaggtgagttcacaactctattgggatgcacatgagaaggtaaaagcattcattggtggaacagacggggttagtatttttggaaaaaactgcactgaagggataaaccaggtcgcgtatggcctccgactgaatccgggggatcatgtaatcacatcagtcctggagcatcattccaacatactcccatggatgcacctgcgaaaacagggtatcagcgtggactttgtcaggcctgatgcagagggatatctgcacccccagtccttttcagaactcattcaaaaggagaccagacttattaccttcacccacgtttcaaatgtaacaggaaccatccagccggcaaaagagatatgttctatctctcatgaccatgatataaaaaccctgctagacggtgcacagtccgtaccccatattccggttgacgtatcagatattgggtgcgattatctctcattctccggccataagatgcttgggccaaccggaactggtgtcctctggatgaaagagccagacctggaaccatttattctgggtggcgggagcatcaaatcggtaacgaccagcgaatacacgttggaagacggttatatgaaatatgaagcaggtacccctcacataaccggagcagtgggccttcgagaagccataagaattctaaaccatgttgggatgagatctgttcaggaacatgaattatccctgacacgggatataatacacgggctttctcatatacccggagttacattgtacggaccaaaaggaacagactcacgtcttggtgttgtctcttttactatcgagggtcagcatccgcatgaatcagcccatctgctggatgatcaatatgacatcatggttcgatccggtcatcattgctgtatgccattgatggatcatttcgcgatcccggatggaacggtcagggcaagcctgtatctctataatacaagagaagaagttaaaaaatttctagaagcggtgacagaaatctcggagggtatctgaatatgtatgaaatacttccctgttatggagaagaggatggcgtttacacagcacggactcatgaagtgattattgaagagcggtataccatctgggtcaatggcaggaagatcctgaacgccatgaccagtccgaccaggcttgaggaatttgtcattgggtatctggtgacggaaggaatcatctctcactgccaggagattgactcactgcagattgaaggaaaccagatcagagtactcaccattcaccgggcacacatccgcagtggaactaagacggtcctctcaggatgcgggggagacagttcataccttgatccggccaggctcccggacatcacttcagattttcagatatccggagagagaattcatgcgacaataaaaaaaattctggattcagaccttcaccggttgacagggggtattcatgtagtcggacttgccggtattgatggagtccataccgttgcagaagatattggtagacataatgctcttgaccgggtgataggctatgccctgcagcatgacattgacttatcacactgttatgcagtaatatcagggcggatatcttcagagatggcacgaaaatgcctggtcgcgaacatcccgcttatcgtatccaggggagcgacaacaaccctcgccatccatcttgcacagggcaaaggacttaccatcatcggatttgtccggggaagaaaaatgaacatctatacacatccggaacggatacccgggatagaaatcgttaaataaaaaaatttaggaattgagtgcattccagaaggtcaaatcaaagagagcttcctcactgacctcacacttcaggtaaccgagttcactctgctgttttgcaaacgtaccaacagatgaagtgatctttgtcggatcgatctcaaaggaaccatcccactcgtcgagtgactggattacggcctttggatcaatactggtcagtgcctgcatatgttcagcagcctcatccggatgctcattattatactcagttgccttcagatgcagacgaagaacttcctgaacaatatccggatgattccgtatcatatcaccacttgcgaccagcacacaacaggaatgccctttctccatttcaccagaatggacaattatcctgcctacattctctttttcaatggtcaccggtgccggatggggaagaaataccgcgtcaacctgtccagcaagaattgcagtcgtcgcatcccctggtcccattgcttttatgtcaacatctttgacaggatcaatattgttggcctgcagccattcccgaagaatcgtatcctggatagtacctgcagggaatgtcgctatctttttgcctttcagatcctccggcttttcatagggtagatcctttttcataaccagatctgagccctgggtatttgcagatgcgatgatcttcgcatcaagtccattcgatactgcggtcacaaaaggagcagaaccgacatatgcaaagtcaagatctccggcaagcattgcctgcatttcaggtgcaccagtcgggaaattaaaaactttgatatctgataccccgattggagagagagtttcattgtaccagcctttctggtacgcagtcatgaaagccagctgatgagtgctcggctggtatccaatggagacggtacttttttcttgtgattcagcaaacactgaaacagtcagagaggtcagaataagaccaaaaactgacagaataaaaaacattttcatgcaaaacgtatgtgtcatcagaacactcctgtagtcccatattcgcagaacgattatttaaaaagtcatcaataggcaaaccatattttcctaattgtgttaagaatatttgtagtaaatgactcaatgtatttttattgatggattttgtacacaaaataggcaatacctgcctgaaccaaagaatattcgagcatcataccacctacctattgcatattacggactgccagtgaaagaaatttcattcatggagatcctgaagagaaaagttatgccgttcatgaacgaaccctcctgtaaccgttacaaatttacacatgaatctggaaattatcggtatcatgaaaaaattaaggagaatttctgatccctttccataaaaaccccaaaatctgaaggaaccctataaaggaaatttttcagtacatctaccccgatcagggcatgagagagacatgtcaggtaatatgctggcagaatttacttagaaaggagaagatatgaaaattcgttatcagacatatgcacgatttgttgaattctttggaaaagaaggcgacattgaagttataccaggaacaacagtccagggatttctcgaactccttaccggggaggatgaaaagaaacaatccctgctctttgatgagaacggaacagtaagaaggtatgtaattatactcaaaaacaaagaccgaatcctgaacgaagagactgattctacagaccttcaggatggggatgaactcataatctacccacctgtttccggaggctaaatgatattcatccagaaagaaccaatagacacctcacacctgtttgatcttatctccccagagacaggagctttggtcctctttgccggaacagtccgggctgatggaatggatcatctcctgtttgaaacggatattgatgaggctgaaaaagaacttggaatcattgtgaaagaggctgattcaaggtggggccctattcgtgcacaggtgactcaccggtatggacggatgcacataggcgaggtaattgtcctgatagctgtcgcagcaggccaccggaatgaagcatttttagcggcacgatatatcattgatgaattaaaaacccgggtgccaatctggaaagcagacgtcttcaacgacaaggtcgcatggatacatggagaaaaagaataatcctgataccattcagaattcaataatttatgcgaataatgctgcaactacctggccaaaaccaccatcagtattagtcgcggtatcacaggcagcagccggaccctatcttgaacagggaagaaccaccttacaggatgtacccgactacctgttcgaaacacgaagaaaacttgccaactttttcaataccagcgatcctgatgcatatgtatttaccgcaaatgccaccgattcactcaatctccttattcacggatttgctgcacaggagaaagaagcatttcatgtcattaccacgtcatttgagcataattcggtaatccgccctttgtatgaattgcaaaagacgggcaggatctcggtgacggtcattcctccgaatgcagaaggggtaatcgatcctgacgacgtgagcggggctatacgggatgatacaaaacttgggatcatctctcatgcaggaaatgtaatcggaacggtccagaatatcaaagaaatctcccgcatcatggatgaagcagacactttttccataattgacggagcgcagagtgccgggcagatcccggtcgatctctcaaggacagtgtgtgatgcatttgtctttaccggccataagtatctttttggagttccaggaaccggggggttctttctcaaacgtccagacaagatttccccggtacgacagggagggaccggcacagattcttcctcaccagttcagccggaatcaatgcctgaacgatttgaagccggaacaccaaacttccccggcatagcaggactcgcagcggggattacatttgttcatgacatcgggatagacaccatacaaaagaagtctatgggaatgatctctgacctgattcagcagctgcaggagatcaaaggagtatccttactccatgaaaacccgcagaccccccttgtttcgtttcagattcccgggctcgatcctgatgatatcgggtacatccttgcaaaagcataccggatcatctcaagaagtggcctgcactgtgcaccgtggattcactcccgccttacagagggaaaaggggcggtgcgtatcagtttgtcatacatgaacacctttgaggagtgtactcagatcgctgatgcaataaacgcactatgccagtcagtataacataccgggcaataacggcaacatgcacccagggaattttcagatatatatttcatgtagatcagaaacccgattcggattttattcagtttctggttgataccaaaaaagctaccatatatacaatcggtccgtcaacctttttcagggtcgattcatcctcgtcattatccatccaaggaatggttcatgatccggatatcatcatatcaacaaggttgtcagaaaaagaggtaaaagaatttctttccaccctttattcggaatatgagggacatatcagtgaatcaggaaaggaggagcagtcaggaagatgatccacccataatgacggtatatggatctatgtcagaatatagttcggtataaggaaagcaattatatccatttttacaattttttttcaaataccgaactgaattccgcattttcttgagagatcttccagtcccagggatcatgaataatggttatctcaacatcagaaacccagggaatgaggcgtacccgtgctgaagcctggtctatgagatagtcctgaagtggacatgcatcgcagttaatttccatttctatcttaaccagtgtgtctgttatcgtaattgatctgatcagatcaacatccacgatattatgcccgatttcaggatcaattacctgccttaatgcattcagaacttcagaatccctatctccggagattttcagttctgctccgcctttcaacaacgcattctcccgctccagcctgaatatgcggccctcaagtgcctgctgccgctcaagcaatctgctgataacccggagggtcggatcaggcatagcagaatcgcgaatgttgtcctgagtcgtgtacttctcgagaccggcaatacgcccaggaaccccgactacagtagcacctggaggtacatcccggacaacgactgcacccgcaccaatctttgcatattctcccacataaatcggccctagaacggaggcaccagaaccgataaccacccctttgcctattgtggggtgacgttttacatttttcagtgcagttccaccaagaactacccccatgtaaataagaacatcatcaccaacttcagccgtttccccaatcaccacacccatcccatgatctattaccacccgtctgccaataatggcaccagggtgaatctcaatcccggtaaaaaagcgggcaatatgtgacaggaaccgcccggtcagaaaccagtcatgaatccaggccttatgagcgatacggtggagcaataatgcatggagtcccggataacagaggagaatctcaacaacacttttggcagccggatcttttgatataatcgcttgaatgtcttcacgtaaatgagataataccatccgtacgttccatctgatgaatactactgttgcttttcagattatttattcatggaggaacaggcaaacttttgatttttttttttcgtgaaaacatcagaaaaatttttataaacgaacgggttttcacaaaatatactgtatgatgatatacataagccaatgaaattctggatcaataattttgccggcatcatcaaacctatcatacataacaccaaaactaattcatgaatgaaacttatgctcccggatcaatcagtgattgaggtaaaggtcgagggaagaacaatcgagacgatactaaatagccagggcattgatccgctgacgacattgatttcacgggaggacgagatcatcccggaagatgccatccccgatgaggaggatgtcataagagtcattcggatctcccatggcggataaaaagatacactgcgaaaagtgcgaaaagcccgcagtctaccttgaccgggagcgggaaattcatctctgcagtgaccacctgaaagaatctgtagagaatgaagtgcgaaggtacttgataacgaaaagactcccaaagacactcggggttgccttttcaggagggaaagacagtaccgccttactcaaagtgttgagtgaaatcaggagtgaattccccagtagtatcatcgcactaaccgttgatgaaggaatagagggatatcgtcaggatacaatccgggcagccacagaaacatgtctgacacttaggataccccatgagatcatcaggtttcaggacctgtatggacactctctggatcatttggtatcaggatcagagcgaaatgcctgcaccatctgtggaatccttcgccgtcgggcacttgaagttctggcgcaaaaacataagatcactatgattgcgaccggacataaccaggatgaccatgcccagaccaccgtgatgaatgccatttcaggagatgtgagaaagatctttaccggatatgaaccctcctcgtggtacgcacaacgaatcaaaccatttgccagggtgagcgagaaagaagtaactctctacgctctcctgagcggattatttaaagatctgtcggagtgcccatatgcagtatcttcacttcggggagaggtcagaacactcctgtaccagtatgaacaaaaacatccaggagcaatgagaaatgctgcccggtgtgaagaagagatcagggaaagattaggagaaatctaccaacaggaagcatataagacctgttcaatctgtgggtggccgggttcgggaaccatctgccaggtgtgtatggttctcggcaaggatactcaccttcaaaatcctatgacgaaagaaaaataagcagtatcattgcagatacacctcatctactatcagtacatacatatattcacgataccatggccagtcaaaagagcatttacatggatcacagtgccactactgccactgattcagcagttgtagaggccatgctcccttggttctcgatcaattatggaaatccctcttccctgtaccgtcttgcacgagaatccaaagccgcgatcgaggatgcacgaaaaaaggttgcaaacgccatcggagcgaaatctgaagagatatactttacctccggagggaccgaatcagataactgggcactaaaaggtactgcatttgcccttcaaaagaaaggaaaccatatcatcacttctgctattgagcaccatgcaatcctgcatacctgccaatatctcgagaaacatggctttcaggtcacctatcttccggttgacgagttcggacaggtccgtatagaggatctcagggcagcgatcactgataagaccattctggtctcggtgatgtttgccaataatgagatcggcaccattcagcccattccggagatcggagcgttctgcagagaacggggcattcttttccataccgatgcagtccaggtgattggcaatctccctgttgatgttgcagcgatgaacattgatctgttatcactctctgctcacaagttttacgggccaaaaggaataggagcgctctatatcaggaaaggagtccgtatcgataattaccttcatggaggcggacaggaacacaggaaacgggcaggtacagaaaatgttcccgggattgtaggtcttggcgttgcaatccagaaagcagttatggatctggatgtaaaaacatcacggatacgagcccttcgcgatacgttactcgatcggattctccatgagattccaaatacccgtctgaacgggcaccggaccatgcgactcccagggaacttgaacgtcagctttgagtttatcgagggtgaatcattattgctactccttgaccatgccggtatcgctgcatcgaccggtagtgcctgttcctcaggatcacttgagccctcacatgtattactcgcgataggtctcccggcagaggttgcccatgggtccctgcggctcacccttggagtgcaaaatacagaagaggacgtgagctacgcatgtgatgaaattaaaaaagcggtcgaacgtttgagagcgatgtcaccactctatgctgattacctgaaaaagaggtcatgcaatgtatagcgaaaaagtaatggaccatttcatgaacccccgcaaccagggggagataccagacgcagacggtgtcggagaagtaggaaatcccacttgtggggatattatgcgaatttttctcacggtgaaggataatatcatcaccgatgtaaaattccagacctttgggtgtggagcagcagttgcatcaagcagtatggcaaccgaactaatcaaggggaaaacccttgaagaagcctgggaagtatctaataaagcagttgccgaggcacttgagggacttcctccgatcaagatgcattgttcagttcttgcagaagaaggtattcacaaagccatcaacgattaccggataaagaacggattggaaccctgggaagaaaaaggtgggcatacccacagtcatgatgacctggcctgtgaggagtaacccgatatcatttttttagcatttctgcatattcgaacgcaggcattacctggatgatcttatcatccacctctaactgttctgaatcattcatagtgagaatatatccgggaactccggggtgtgaatccatggcctcgattaatccacgaatttcacgatttcgtacttcagaattttccaaagatgtacatacctgaatggcgctaacaatccgatgattctcctggattaaaaaatcacattcatatcgtacccggtgataaaaaacagaagactctttcttgcggataagtgtagtaaatacgtaattttccagaatttttccggcattctctgaaaatttaaatgatactgcatttatcagacccgtatcaatacaatagagttttttcatattgtaaagttgcttctttactgaaggatcatatttcagaaccggatagaggagatatgcatcataggcacattcaatatactcacgtaccgtatccgttgagattccaatctgttcaccaagccgtgtatatgaaagcagatttccagtgttggagatgagaaaatagaggagatccacaagatatgcaggactcctgatgttatgtgccatcataatgtccttgagatagatagtttcgtaatacgatgtgagcagatcatgtcgaagagagatatctgattccacggtgatccggggaaatcccccatacttcagataatgttcaaaaagttggttcttcctggtaatacttacccttgtttctcccagaaatgagagatactcttcaaaagaaagtggatatacagtaattgaaagataccggccagatatcttcgttgccagatttctcttcaaaagagaggaggtggaactggtgagagtccatttaatttgaggttttgtatcatatgaaacctttattgaccctacccattcttcataattctgtatttcatcaataaagataaaataatggggtttatttattttttcaaggtattcttcaatgagttcattgagaaaacctggatcatgcatccatccggtgaagagtggttcatcgagatttatataaagtattgaatcaggatcagttccctgatgtatgaggtgctccaccatctggaacatcatggtggattttccgctccttctgactccctgaataaacaaaatttctcttgcatcaagataccggattaattcaggatatgaaccgagccggttctgtcccgtgttataggtacgtccaaaccaccagggattctgtctatcgaggactgcctggattcttcgatccatttgttagatataatcgatgatttatgataaaataatcgattacaccagacgattttaaaataaatcaacaatcataatcgaggatttcatatcagtaaaacaaaaattaatcagatcggacatttcccctgaccatcgagaagtatatcccgataaaacacatcacagaaaagaccataaatccgatattcatcgcaatcatgagctcatctgtcatatccggagtaatgtctactttccccaccactacggcgattatcatcatcgctattcccatcgagagcatctgcccgagcagccgcatcgttcccaacgtcccggatgcgatgccataatatcgcttttccaccgaactcatgattgcattggtatttggagatgagaagagagcaaaaccaaacccgagaaccgccaggattaccataagccaaatcgtggaagtatctggagagagaaaacttaaggagacgagtcccacagcaatgatccccatgcccagagatgatattttcgcaggttcaatcctatctgaaagactaccggcatatgatgagaagattgcctgcactaccggctgggtgacaagaataaacccggcctcctgcgggtcgaaacccctgatgtattgtaaatataagctgagaaagaacgttatcgcgaaagttgagccgtaatttatcagagcagcaacatttgagcaggcaaacacccggtttgttctgaacatggacacacgaatcagcggataccgttcccggtgctcaagccagataaagagtgcgagcaggatgattcccaatccaagagcaaaaaatccagcgacctgggggatctcggaaaaaccgatcatcaccgcagtaaggctgctaccatagatgagagcccctttcaaatcaaaccgctcaccagctgcatcagcccactctccttttagatagaagaggataagggcaatgataaggatgcctatcggcacattaatgaggaagatactcttccatccgaattcatcggtcagaaagcctccgataaaggggcctgcagaaagaccgatgtacactgatgtggtgtagatcccaagagcctggccccgtcgtgtgggttcggtcacagatgtcagaatagccacggcggttccaaagatcatcgaagccccaacaccctgaatcaggcggaagctgatgagcataagagacgaagctgagaagatcatccccatggaggaaagggtaaagaggattaccccaccggtcaggatcttctttctcccaaagatatcaccaattctcccaaacggaacaaggaaggccgctgatgccagaagataggcactgctgacccagcttaattcaatcgcatcaagagagaactcaccggcaatcgtcggaagggcaatatttactgcagatagatcaaatggggttaaaaacccacagcatacagcgataataagggtactgagggagatgccagggaccttcattgaggaatgaagatattcccccatcacccatgaaggttgtgtaaccagatccttttgtttttacactgaccgaatccggccataccggtcaacatcgtccgacctgactgatgccatgctgtcaaagagacggcatttaaaagaacctgggcctgcagcatccacagcagcccgctccccggcaatcccaaacgcagaaacccctgtagcggatgcagagagatagtcctgtgtgactgccgcacaggaaccgataaccgatgcagccatgcatcctgtcccggagattcgtcccatatatgggtgtccgttctcacagagaagagtccgggaaccatcgctgatgatgtcaatgggaccactcataacgacggtgcatgaaagtcgctctgcaagaccacaggtgatttcagttggatcaccgttcactcctccggaatctactccacgaacctgtgcctgttttccggcaagggtcccaatctctccggcattgcccttaagaaccgagatggacaactcctggatcattctctgggcggttttcgtccgtaaactggttgctccagcaccgaccggatcgagaatgataggaataccatacttttctgcggcttttgctgcgataaacatccggtcaatctggagggtatcaagggtgccgatattcagaacgagggctcctgcaagtgcaaccatctccccaacctcttcttctgcatgggccatgaccggtgaagcgcctatgcagagggtgatattggcacagtcattcaccgtgacatagtttgtcatatggtggacaaggggcgttttttcccggatgtcggtaagtattgatccaaaaagtgtcataaaaaaatccagtatttctggataagtctgcattgtacgataaattattttgtaatccggcagatgggaaatgcatactccatcaggggatatttcgtcttcccggtgatatctggtatcaagacatatggagagtgcttcatgaataaacgagtttttcaagcatatcaagatccatgaataatacgtttttctcatcaccgacagatgagaaagacctggcaatgatcataaacatctcattccgcttcttttctttccatgttataagaccggctttatgcttcaggtcaaaagccaccttttttccattaacattatcctgccattttacctcacaaaacagaacggatgaatctgtttcagaaataccaacaatatcaatctcttctcctttatgccaccatcttttcactgaagaaaatacacagtgaaaaggaagttttcctgcaccattcagataaaacaacaggtcaataaccattcgttcaaataacgaacctgtgtactgtgcaagatagggagtaatactctctgtcaaaatctgttctgcagatccactttcagcacgttccaggttaggaaatataaatctgaaccagaacgaaaacaaattgtccctgaagaaataacgacctctcctactcctttcatcctcaaatgcagggacttctttccatatgatgtccagatcaataagtgttgcaagataccggttgaccgtacctttctgtataccggtatcattggtaatcagatgttgagtattatttccccgtgagatggagagcaggattgaaaaataatatcgtggttccacaagttccatccggagaagaaattcaacctctctgaacagatatgaaagtggattgagcagatttttctcgatagaatcctcaatggtttcactggtatccacactcagtatgtaggcaggagtacctccatacaccgcataatactcaaccgcttttctgaaatcctgaaatattggtagtacttcatgaaaccggaatgacctgagtaaaagttgtccggttcttcttccaaataagggactccgatatgaaagaacctcatcttccatcattccaatcgatgaaccggataaaatcaggaaaatacgggtttttcgcagtctattgtcccaatgatactggagtatcgagaggattgatctatcttcttttaccagatagggaaattcatctattgccagaatgaaccgatttgtcgagcgggatgcaagatattcaaagactgaatcccaggatatgaaaccattttttccaataaatggatcctcaaaaaattcgcaaaacgcctctgcgaattgttctaactgatattttcgtgaaccctcacgaatctgaatgcgcagtcccgtattctgacggataaattcattgataagttcactttttccgactcttctcctcccatagatgataaaaaactcagaacgtggaccgatgaaacgatcgttgagctcagccagttctgttttcctatcgaaaaaagtgtacattacattatcataatcgagagtacactaatatcttttgtgccaggctcgtttatcactgacaggtatcttatcttctcaccccctattattcaatgaaatgcacgagccggctgtgaaaaaaacactgtactggtgtgaacactgcaatgttcccctgatcggacgaacctgcagctgcggcaatgaagcaaaaaccatccctctccttcagccctatgatctccggcctgctctctcggctgatcgggatcacatcatccacttattaacatcccaatacggcgacattcctgtcccgaaagtaattctgttaaataagaccgggggatatgatcgtgcagaacttgttatcatcaatgggcagcggtttggctggtttacgtttgatccggtgacaaaaacctattcacttgatatcacccctgaagctctgccatttctggtcccccacataacaaaaggaatcattgacctgactgctcatatcgatctgaaggctgaaaaagggagaatcggcggaaaacgattccccctgaaagaaccggtcccggatggatcagtcattgtcacggcaaatgggaagtacgggacagccattgtgaaagagggatatatcaaagtaaaagaactcctcccgattaccccctccacctatccggaccctgactgggaagcggtcattactcacaatacgtatcatctgaagaacctggagcggaacgcggtcaggaccattaaaagtcacatgaaagaccggcccacggtcaatgtatcgttttccggtggaaaggacagcacggcagttcttcacctggcacgaaaagccggagtggagaaggcattttttatcgataccggacttgagttccccgaaaccatccgattcatcgaggagcagggggttgagatcatcaggaagggtggtgacttctggcaggcggtggagaaagcaggaccccctggcaaggacaaccggtggtgttgtaaacttctcaaattacacccactaaagatatatcttgcagacaccggcccctgtgtcaccattcagggaaaccgctggtatgagtcatggaaccgggccggtcttgatgagaccagtcagaatccggcaaatcccctgcagctgaatatatcccccatccggagctggagggcctttgaagtattcctctatctctggtggcggaagatcccattaaaccccctgtatgaacgagggattgagcgaatcgggtgttatctctgtcctgccatgcttgaaagtgaatatgactctatccgaaagacacatccggatttcaccgagcggtgggatgcatttcttcagaggtgggctgacaagaaacagatgccggacgcctatactgactggggtctgtggcgatggcgggcactccctcctaagatgcgtgagttatgcaggaacatgggagtccatgtcaataatgatttcaccctggcaccaacgaaggagagaaagaagaagcagcaaagccagaacggctctcctatagagcagaagagagcagaagtaggactggagttggatgatctaatccgtgcaatcaggcatgattatcccatccttggagatgtcgtatacctggataatgctgcgaccagttgttcgcctgaaccggttgttgaggccatggttgaatttgagcaccggtacaggtcaaatgtcggaagaggggttcatcggtttacccggatagcgacccagcggtactggcatgcccatgaaaaggtagccgaattcatcggggcacagggcggcattacggtctttacaaaaaataccaccgaagcgataaacatggtcgctcatggcctcagctggactcctggtaaccgggttgtcacgaccatccttgaacatcactcaaacctcctgccctggagatcacttgagaagcagggtgtcacccttgatatcgtcggcatacgtccggattattccctggacatggatgcattccggaagatgctggaaaaaccggtcagacttgtggcaattacccaggcatcaaatgttctcggcatcattaccccggtgcatgagatagctgccttgtgcagggaaaaaggagtgcttcttctcatcgacggagctcaggcagccccccatatgccggtgaatgtatcgtcaatcggatgtgatttctactgcttttccgggcataaactaggcgggccgaccgggactggtgttctctggatgaaagaacccctactgactcccctgatgcaggggggtggaaccgttgaatcggttaccggtgacgatgttgtactgatacagggttatgagcaatacgaagcgggtacacccaacatcgccggaggcatcggattaggcgttgcagttgattacctcaggaaaatcgggatggacacgatccattcccatgaagaagatcttaccagccgcctgattgaaggcctccataccatcgagagagtccgggtatatgcatcaggaaaccccgaaaccagaataggggttgtttcattcaccgttgaagagatgcatccccatgagatagctcaacgactggatgagcatgatattctggtcaggtcaggacatcactgctgccagccgctgatgaatgccctgaatctgccagatggaacggttcgggtcagtattgcacattacaataccagagaggagatcgatctcttccttgctactctgaaagagattatcgccggttcttcaccaggtaatccgctcaggtcgtgatagtatcaataatcgggtatcctgtatgataccaatacatagcccgtttttctgacctatttgagccgcaagacgtgtgcaatgtccggtcgtgaggagaaccgggatcccggccatcaggcattttcggacggtttcagaagttacggtatgtgaacagagacaataggttgatgagaaatcaatttttccgatgagtcctgcgccaatcatccggtctgtcacctgatcatcgccgatatcctgccggaacatgaggcattgaggaggccggtatagagctgatacaaccaggcccggttgtctctcctcattggccatgaaatgagcgattgtgggtgcaatggttgaagcagggatggtaaaggtcccagtcagaacaggaagtttaccaggatcgatatacgagacagcaccgccgcatccggatagaattgtttttttcgggccggggcttgagaatatatttgtcgtgagaacactggcacggtttttttcaacccgtattgactcaatttcatcggcggttttgatatactgctcagtaaagagataaccggtcacatattcacggatgtttccggaaccaagaagaactgttgagatatgcctgccattgatgaatatcgcaaccggttcctcatcacacaaaagtgaagcagcatccttcggggaaccggacagatgctctgatgagagatcaagaattttcatagacggatggaactttaagtaatctgcatattatatccagataacagaatataaactcatggagtaccaaatcatgggtatgatcagtcattcctgcctttcaaggctgatgtttggaatcatcgccgttcttatcatcctaatctccctctcgtcaccatctgttggcatttctcatcctgccaatgtatctgatcccgatctccaaatcatttcaatcaatattccaccggaagaaagaacggtgtatcccggagttactatccatccgatcataacagtttataataaaaacaaccagactgatatgaaaaattcgattctgctctctgcaacgcttgggccggccacccttcttcagaataatacctatctggatgctccgggggatggagagagcagggagtaccgcataccttttatggtcccgtttattcagcccggaacatacgccctgactatcagtggagagcagaaattacgtgatggaaacaaggggatcttgtttggaagtatgaaatcaaaaacgatgatagaggtgaaacaaccaagaccagagaccgggaaaaagatgtgtaattgcagataggttatctgaaaattttatccctgaaataaaaaataccaaagataccgagagcagtgagtatatataactccggatggctgaatagaaaagagagatccgacgttttatcctgttgatagtatgtatactctctctttaatctctctaaaagattcgtctgatccggagtgagagctgattttgggatagaatcaagagtctcttttgctttcgccatctttccctgacgcatccgtgcctcagcaagacccagggaagcgtcaatatttttcggatcgaacgagaggctattttgaaacgattcttctgcatgtctatagtcctgtaatttggaatataactcgcccatataactgtacaccagaggatcattaccggaaaatttcagcccttcaagttcctgaatggctttatccggcatattcagggtagagaatgcacgagacctcttctttcgaagaccatcagacattcccggatctgtttcattttgaagggaacgattccaggcatcaagcgcagaatgaaaatccccttttgcccggtaggcatcacctgtttttctggaataagtaggatttccgggatcaatctgttctgcaaggagataagattgaagagctgcatcatactttcctgattccatgaaccgatccccttctctttccaattgcacaggatctgaaatgaccacgtatccgggatcagatccctgatggtgagagactatgctttcaccgttattggcatcaaccggatattttatccgctcagcaccaaacaactcacggacttctgataaaggaggagaagatgagtcatcacaggcatcaggattgagaaggcatctcccggttttaaaggcatcttcagcctccatatctctccccatgtcagccaggactgtacccttccagagccatccatagggccaggaaggatcagtcagaactaccgattcaaataactgaagagcagtgtcccgatcaccggagttatacatatcaacaccttcggcaagtaatttttcaatttcagcgggtgatgcagaagccccggatacgaggagaaaaataatacagagaatcgaaagagtgaccggtgaaacgttcccattaagaatcatatatcattattttttaaatgtttgtaacaaagtatcaatttcatgaatcatttcccgaatatctccataccgttcatttttatcaatatgcacggattttttaataatcggatcatacactccataatctgaccgaaaatgtgagggaagtgaacttatgctttcaaaacaattgagaacctgtcctgataaaagataataaaagatcgcccctacctgatagatatccgtctttttaccaggattgccaaatttttcaggattcctctgctcaggggcaataacccagcaatcatcaggaatgccagactgaatcaacgcagaagtatcaaacccagatattttcggttgtaatccatcatcaagaaagatgacagagggctcaagaaggtagtgtcggacaccctgtcgatgtatgtaatcaatcccttctgcaagcccccgaacaatacgaagtgcagccctcgcgggtatgggcactttcagatctgccagcgaatagatcctctttttcgattgtattgcaccggatggaagatcaaattccaggaaataaacaggatcacgttcccagaacttgatctgcataatattcatatgcttaagtgaccgccacgcctgtatctgtaattcaacctgagaggcagggattaccccggaatcaagaaccctgacagcaacttctatattatcagcagcccggagagcccggtacataataccaagcctatctgttgagatcaatgcagatggtttgtagatgggcagtaaagagtctggaaatcctgtcaaagagggagagagagatacctgagtggcattgccttcctgtgcatccacctttctctttacatcaggctcatggtcacgtatgtcagatgaatccatggtattaacttctgaagaagaatccatcttcctcttaatcagatcccgataccgcttgagggtaccatcatcattccccaaatcgatctgctggttaaaccattccagggattctgagtactttttggagaagaatagaaatatccccttattgtaagggatcttcaccgacagcgggaaggaatattcattttcagtcaggatacgtaattttttgtataccgatagttcatccgaatcaggaacgtccattaccaattcgataccccgctcttctcctgatgcaagaaggattgaatctgcttcaagaggaaagggattattattttttatcttgagtattgcaatgatattcccttttttctgaatgaagcgttcaaaaaaccatgacagatcgaggtctctgggcatgatacgatactgaaggtgaattacccggcttttttcttttccgttcccatcaatatacgaaaccgcctgggatacctcacaatctccgggatcatcatcaaatatctcccgaaaaacaatcctgcatactccgggttcaatccgaatcgtatcaacaacaattggttttgtccccatgtttgtaattttcaatttgagtgattttttatctccctgtttaaatagtcctgcaacagggtcaaacctcacatcatcagatgatattcttcttcgtgtttcgattgcaaaatcccggccactctccttctgaacagaggagggaaggacatgtgaaaccacgaattttatccttttgatctcaccagaaataaccacaatcgaaattaccgctaccgtcgtcagcgtaataattaccccgaggatgatgaaaaaattagataagatcaaagtcaggacgggattggagttttccagtaagagtgattcttttgtttcaatcaaaacccctgacttttccggactataggtgattgaatggatggaattcggttttacctcgatatcgctctccatcacaccttcttttcctttaaccacaacatgatgaatgcccactggaatatgaggaagagttaacggggtcagacctgcaggcataccatcaagttcaacaggtacatgaagtggccctgcagtaacctgtatactaccggaattctgatcattatgtggcaatcccgtggtaatttccattgagaggaacactggatctgaaatcctgttcgttttcccgcttggtaacaatcgaacaacagcaaaggcgagttttacctgaccgacattatgcgctgatatgagaaaagggaactggtaactctgcccggtatgaacccgggatcctttcggtaacagttgtaacggtggatcaacggtgataaggtttgaatccccagaatattcgacacctatcttttcaacatcatgttcccaggcagtcatacccgtattacgaaactcaaccatgtattggccattctgacctggatacattacatcaggaatactgtctgaagaatactctccgccctgaaacgtaataccagatattgaaccctgatcaacacaacagacaggggtaataattaaaaaagatataaaaatgaagaacaatagaataaaaaacgaatgggaactcatgcatcatcaccggatagtgccataccttcttttatataaaaatcaggtattattcccttcagatcatctaaaaatgcctcaactgaagcataccgatcctttttaaaacgggctgtaagtttctttaacaatggaatatacaattcaaaagagggatcagaagtcacattatccattgtcattgaaataatctcatccgcagattctcccttttccattatccggccggtcatcagccagagccatattactcccaattggtatatatccgttctttttccgggtttgccaaaaaaggaagggtccacctgttctggtgcacagacaaaaaattcctcaaccccgcctcctcccgcacttcgaagtgattcacggataagaccagatattttaggattcaatggctcatccagaagaatatattttggtgagagatggtaatgacggacaccttgccggtgaagatatgcaagcccttctgcaatcttttcaatcagcagggaagagacatgattggggagcgggactggtaaatctgataccctcatatattgtttatcttcataccaccctccggagacaaattcaagttccagcataacaaccggataaaattctgctttatacatccggagcacatagggatgacgaagttgatagagaagagagatttcagtgaataacgatgagccgattttttcaatggttcggggaattttaagagcacgtaaatcaccggtgtcatttttccggaccaggattaccgtagcaaacggatcatctcccagaacacggataggagtataccggtcagataattcatcaggatatccggaaattttaattacagcatctgaaccagctttgtccttttttcgtgctgctttatcctgaatttgattcagagcattcagggcagcttcatgttcaggatccaagaccaggatctcttgcaaaactgactgtgcctcttcttccagaccccaatttaaaaggatttgagcctgttgaaataatccgtcaacattgtccgggtgtgtcaccagtaatgctctaaaatactcatatgccttttcaaccactccccgtgcaagtaacgcaatcccccggttatatgggataataatatttttaaagaactctgaaccctctgcaaaaatacgaagtgaaataattgtatcaggttcatcattcgttggttcactgatttcaacaggtactatcccgaatccaccaggactgatagtgtgatcctctaccgataccggaacagaagaatgatttgatactccaatgctcgctgttgcagaaccgggccgggttgttaaatcccgaaactggaaatccacatcatcttttatagtatctggttttgttggttttgaggagggtttcggttttgaggaatctttagtagaatttttcttttcaattccttttgaggatttttttcttgaaatatgaccggttccagatcgatcagatactttgccatatacgccatgagagatatcagatgatgatgacaatccttcaaataatggttttttgctatgtattttatccagtagatctttttctttttttgaccgctctttttcagggtcctcttcatcctccttatcttcttttttctttctatccttttcggttcggtttcgttttctcagtccatacataccaacaccgatacacgcaagaaggatcaatgaaattataattatcaatggaacattcacttcaatatatccgataagggtcccgtcagataccggccctgcccttttctttgtaacaaccgggattttttcatcacctctcacgagaagacgtgtcataactccccgttccacatcaaccgaaaacgttcgctcaaaggtatcattctttacccgtatcatatactgacctggtttcacatcagcaattatcgcagggacatttcccataaatgctgaatcaaggtaaacatccagatccagtaccgggctttctacaaagatcgacccatttaccggtgatgagatcccgtcggttgggacaatagtcacatgctttacaaacacttcggttatcttctggtcaccggttgctgaccgcatgacaaccgagaaggagagatcataagaacccggagtccccaccgggaggagggtaaatccaaaagttgcatgtttaccgggggtaatattcagatcacgggagatctccacaaaagaggggacagcagtaacttttgtcatatcaccttcatagaggaggccaatccgcctcatttcatcctgccagctgacaagaccagtgttccggaatgtaaccagaacaggatatgaatgacctgggagtaaggtatcggggatggtatctgatatgtacgaaggtccaaagccgggagatatcacccactgttcttgtgcataaaccggggataatatcactgaaatgacaaggagaatgaatagtatgatagggaccattcgtaccaggctcaaagaatcagatatacgtacagcctatttatactaccggtttaggcctttctgacgctatcgagatctttgataaattcatccatcagataataccgaccggatttttttcgtgataacatccgcacaatgataggatcatacttctcaagacttttcctgaaagcggatggtaaaatcagttcatctgcatgatcctcaaacgttccttcatgccctgatttttgaaatgcttcaggactatacgggagatacccggtcagaagttcataaaaaattactcccaactggtagatatccgttcttcgcccgggatttccatacttttgttcatccctctgctcaggtgtaataaatgccgcggtagcccctctgacatcagaatccttaacagaaaatccgagttcattccttcccctggcaaaaccggagacctttgcgcgaagttttggggtcaggagaatatctccggactggagatgataatgcctgacaccaacatcatgggcatatttcaacccttctgcgatatcacggacaagggatacggcatattgttcccggataggttttggaagaccgttcagggatgtatgaaccatccccttgtatgataccccgtcaaggtactcattttcaagataggacatatcatccagaaattcagatttgaaaagatgcacaatgttcggatgacgaagggatcgccagaccgctgactctttctgaagaatctcactcccaggctgttttgagtgtccaaccttgagtgcccggacatcaccgctttcttttttcctcaccttatagacacgggcataggtatcatccccggcaacacccagtggttcataccggtcccgaagagcgtgggggaacccatatatcccttcaatctcccgtccttcctggtcagggtcctcgacatctggcaatgattcatcttcttcagtctctatgggctttctttcagaactctccccatcacgccggatttttcgatcacggacacttttccgggttcctgattctgaaccggcagtttttccttgttcccgtctgcgatcaccatcagcaccacctgatgcatccgcaccaccaccggtactttctcctctcccatctttacttaatcccctctggaatctgctcttcccatcagcgtatggagcgagcagaatgaggggccttgtataccgtcttaccggatggtgctcaggaattctcttcgtatccatcatgatgacctgaaatccgaaaaacagaatgatgatgctgatgatgatgagagaaatattatcaaggagccatccaagcggggtaaacttcaggagttgctcagttgataccactggtttttcagatgtagtcagatcaacggtaactctgctgactgatcctggttcaacccgtacctgcgcccattttcggccataatctggatgagagacggtaatctcatactgagcagggttcagatcaggcaacgtgagaggagttttccctttctcttcactgcccatactgaccatggctccggttgggttagattgaataataattgaacccacattcccggatgagaccccctcttttgggataacaatgatctttttggtaaaaccattcggaaaaggcgtatatttatcctcaccctttcttgttgacattgaaaaactgagctcatattcaccaggtttatccggaggggtcagaacaaagggaaatgagatctcttcctgtgttgctactttcatcccagctggaataggagagaaaaccgggtccacggtgatggatgactgtaatccctggtagaggagaccgaatttttcaaccccccattcccatgagaccatcccgttattctgaaatgagattaccaccggatatgatgaaccggcctcaagtgaggatggtatggtgtctgatacataatctcctttataataaccgacacccgatgtcccgcccataccaaagagatcatccgcagcatacacacctggaaccatgaaaaccagaagagtaagaaagatggggccagccatactcatattcatccaattctggtttgttccactcataccaggtactccgtgtatagtccggggaaatgtataaacaattcttagacctatgattcaaaaatgcatccatctcattttcttagacctgatatagaaacgatgaagtatcctgatttagaggcactcatcgacgagcggatacagtatacggttcattatgctgcagaacactcccctttttataaaaaattctttcaggaacacaatatcagccctgatgacatcaaaagtcatgaagatctcctcgaactcccggttataagcggacaggtgatccgggaaaatcagccgccggtcacgagcgatttcatgtttaaaagccttgactggaaagacatctataccatccatgaaacgagcggaacaagtggcactccgaagagtttcttcctctcctgggatgactggaaacggtatgcagaaaagtatgcccgcatctttgtatcccagggatttacagcagaagaccggatgatcatctgtgcaagttatgggatgaatgtgggagcaaacaccatgacgcttgcagcccgtgaagttggtatgagtatcatccccaccggtaagtgtacgttcccgatacggctcatccagtcctatcagccgacaggaattgtagggagcgtctttaaatttttacgactggcgcgacggatgaaagcggagggaatggatccggcagattccagtatccgaaggcttgtcgtcggcggggagagttttgccgatgaatccagaaattacgtcaaagaactctatgactgtgaggtctataacagttatgggagcacggaagggaccatgtgcggagagtgccaggctgttgccggtctccatgttccggaggatattgtccatctggatatccatgatcccaggcaccagcgttttctcccagatggtgaagagggacatattgttctaacgacgctcctaaaacccggagagcgatgcggatcgcttctcatcaattatgatacggatgataccacaaaagttatcagcagaagcaggtgcccatgcggacgaactcatatgagaattctgaatccctggcgggaagcagagaccatccagatctttgaagttccgattaaccggatagacatcgaacgtgctgttttccagcctgaaaacctgccatcactcaccggagagtacgaagcatttgtgtatggcgaagaagagaatgagataacgctccggatatcggttgaagctgaagacaaggatgcatgtagcattcatgatatcaccgatgtgatcaccgggacaatcctgaaatacaaaccagaacttatcgggagttatgatgacgggatattccagatactcgtccatatcacaggcccgggaggactggagcttcatcatatcagaggaagaccaaaacggcttattgacagaagatgaaaaagaaaaaaagaactttattcacttttttgcagagtctgaatcgcagaagagacaataattgccagttgttccacggtccacatttcagtatccagcaccagatggtagggactgagtgatccgatatcaatatcataatattgctgataccggagggcttcacatgcctcccgctcttttgttgcctgcatggctgctgtgaggtcagaaaactgatcccggtcaaatattcgtctgaccctgcactcaagcgaggctttcagccagatcttcaggtctgcctcctgaatcatccagccggacaatcttccttctgcaataatatgagtatttgaaagggctatctcccgttgacgctcatcgatcagtttatctaccgagggatcctcctcacagaatgacccaaactcagccaaagtcaggccccgctcccgtgccatctgtctgaagacttctcctgcagagatgacatccagccggtgcatctcggcaagatgatacgtgagtgaggtcgttccgctcccaggaagaccactgatcgtaatgcgcattacaaacccccaatatcaagtgcctttctgataacctgtgacaatgtgatcgaacaaagcatgtaccatatgatccatgcaggggcaggaccaaggatgagatcggtcagatgaacaagtccaaagaagggcatgtttatcatggcatcaaaatgattgaggcggaatatgagccagaagaatatcggaagggtgataaccatgatataccccataggtttgaactgagcctggctcatctccatctgttcctgcatcatcctggagcgtttggcttcgagtttttttatctgcttctcatcttttgagagcattgcttcccggtattctttttggaactctttcatccggttctgcgtctgtttcatctttttataatcgatggtatacttctggatgattgacgagtaaaaaccggtcattgcggagagaatgatgatcacaatgtaaaaaggaatatggaatgtgtccacaagcggcccgaggacaacgttgagtgaggttccaagtccattacggacggcctcaatgctggcaataaataaaagccccatagccagaatcaggggcatcatactcatggttgctgactgcgatcctgccatgacgtttacctgagcacctgaaccatctcttctactgccttttcaagcaggaagtcagggttcttaatatatcgaacggtgcagccggtcagcatggcatacgatgctgccactgcacggttgaaatcctgatgatcctgaatatcctggtacccttcgatatcacggattcgggaggtatcagataatctgcgctttaagatctgatcagaatcagtctcaacaaggattattaaatcaggttttaactctttcagaacccattcaggaagacctgcaaggaatcctaccggagtttttactgaagcatgagtatcgatgataatgttaccatcgatccgggcgatcgcctgtgaagcaagttgctgaagccgtttctgagaatttttgtctagcttccgcatctcatcacggtctttgacaatattctccttttgcgcaacttcaaacataaaagtgccaaaatttatgctctgatatgggactccttcttcttcaagccgtctgattgactcggtaatgaccgaggtcttgccgaccccgggcactccagtaatgatgactttcttcccggtcatactggtttctcttttattccttaccaaagaatgttcgcataaacggatacatctccatgatctgttcactggcgatctgttcgtagagccgataggtaattgaaacggtaagcagcagaccggtaccggaaacagcacctatcacaccaaagaggttggctactaccgacattattccaataaaaaccccaccaataaccgttacacggggaatataccggtcaagaaccttctcaagaacagccgggtttctccggtatccggggatggacattccggagagctgaatctgacgggcaactgcctttgagtcaagacctgcagtcttcacccagaacagagcgaagatagctcctccgacgaccataatggtggtatcaataccaagtcttatcagaacttcccatggagcatgcccaccgacataacttggcatccaccacatccagtcagacggatgattgatcggggcaagataccacatcaggccaccagtcggagtctgaccttcaaaggttccgaagatagtaataccgatattgttcaggaataatccaatcatctgtacgttggcctgcagaacacggacaagaatcatcggaagcacactggcgtagatgagtttgaccgggaaccgggccctggcaccacgaacctgggtgtgtgcgagagggatctcaaccctggtggattccacatacacaatcagaatgaagattgcaatggtagtgatgaatgctatgagatcggttccgaagtactggatgaaattcgccccgtcaaggacgactgcaaacagtcgggggaaaaatccgaccggatacatatcattcacaggagcccagtttatgaacccgttaatgattgcttcagagataccggctatgatgaacagtccgacaccagagccgataccccatttggtaaccacttcatccatcaggaagatgaggacaccaccaatacatatctgtataaagatgaggatcgctaaaaccccgctgttccctccgaataatgccgaagcgatagccgggtcaggttttaagaatcctccgacgatcatgggcagggcttcaaccacgatcatgatgaaaatcatgagtttctgaagacccatgtactggatctggcccctgatttctgaagtgtcaatgtgaataaggtcagcacctttgaggagctgaagaacgattgaagcggtaacaataggaccgattcctaagtggacaatcgaaccgcttgaaccggcaagcagagcacggaagtactggaacatatcctgtgattcaggagaaagcccgaaaacaggaatattcgtgagagcaaaatataaaattaaaattgctgctgtccaggcaagtttgttcttaaaatgaacatggccttctggcgttttgactgccggcattttggccagaattggctccatccggtcgagtatctcacccattcagaacctccctgggatcaaatcaggagagcagggcgtgaccgcccttcgcctcgatcttctggatcgcagactgggagaacgcctctgcagtaatattcatcttgctggtgacctgaccaccaccaagaaccttctcaattcctatatctgctgcattgagaacgattgcatcgccgtcccgggttgctgtcccctgctcaagaagtgacgggagaatctgatcaatctggccgatatccagaacatttccggtcatggatgtccggtgatggtgcttaaatccacaggtaccataggtccagtttgcatggacgactccacggacaaacttgtgatctctgcttcctcctcttccacggccaccacggtttcctgctccacggcggtttttgtgggttccaccaccacaggttctggaaccccggtacttggaacgcttatttactggcattgcaattacctcattttatagaggagatcattgatattctccccgtgatagcccagcgaaccaccctgctggacagtcctcttcgtggtcttataccccttccgtggcgggtgaagacggagtaccggtttgagacccggaacatcggtcagtcgtgcctgcccaccggcaagtgctgctgcaaagtctgaaattccactgtactgggaattttccttgacatactcatcggtaagacgaatatctccgacaagacgtccacggtttacaagcagctcctcaagggtttttgcatccacttcaccatatgcaatgaaatccttgactttccggatcataccaacgtatgccggggtgtcagggatcagaacacaatggttgatgtgatgcagacggagcatcttgagcgtgtctttgatctcacgacgggtcttgaccgttccgcggacctgtacaaccgcatacatcactccattcccccaagacgaatcatattcgttgctttcagtgcattgaaggttgcctttgcataattgatggttgtccgggtctgtccctgggtctgtgcccagacatcacggatacctgcaagttcaagcactttcttaccgatatctccggtaacaaggccgataccctgtggtgccggacggagtgtgacacggacactaccagcatcgccggtgaccagcatcggaattgagtgcggattgctgcatccacattcccatgaaccacagccacggcggactttaaccaggttgattttggcgcttacgatggccttcttaatggcatcaccgacctgagcgtcttttccctgtccgaatccgatgtatccgtcgcggtttccgacaaccacaactgctctgaattttacccggcgaccagagtcggtcatccgctgtaccatattgatgtcgagcacctcatcgacgaggtccgggaggaatgcatcaacgatctcaggttccttgatgggtttcccgctgctgagtatctcgtcaatactctttatctcccctgcctgaaccatacgtccaaggccggtcaggggcacccattctgacttgtcaaatgccatatcagttcagctcccccatgatagcgtcaaccgtcgctgcaacgtttgcaggaagattgcctgcccggtccggagcatattctgcaatgtgttctcctttgcatcgctcatctgccggaaggatctcctcattgtgaggaatatcaaacccggcctccactgcacctttcagggctgcaaatacccgggcacccggggttgcacggtgaagaccaatgtctagaatggctccttcctgacctgcctttaatgcccggactgcgagaagcataccggtaagataggctgcaggggtgttgtttaaggatccttcatatccgaacttccgaagttctgaagagttcgctgcaacatgagtcctgtctccttccatgtgtgcagtgataatctgacaaatgatgtgccggttggtctttcgaacaaccatacgtggctttgttgctacaacaagccttgtccgggcatgataattggttcttccttcacgccgacggcggaatgctacaaagtagcgtgggcctgttgccattactgttccctccagatctcaatctgtgctttcatgtgggaaacagttctgaactgtcctccggcagcacggcggtaaaacttccggtaaactgaccggtcaatatctccggtctcacgaagttcacggagtacacgacgctgagcacgaatacgctgaatccagcggtctttactattagtacgtgatcctgcggctcctttcctgcgacccggccccttacaatgaccataactgcgcttggccatctgtgcacgggctctgccacgggagtttccccgcttctgatgggctgcaatagcaccatcctggatcaggtttctgatgtcttcccgtgagatcgcctgctgaatttcggtgagcttttcagggttgaaccatacacgattcacaccacatccaagaacatcagcagcgaggcgtctctgaccagaaatctgactcatttactcttcctcctcgttacgttcctcttcaggtgcagccttctctggagatgcgttcttgtgtcccggatgacttgcatctttccagttcagtatacggatattcagttcggctgctttgttctgcaccacttcacgcttcttgcggcctaccgttgcagcaatccggatggcatgggtgattggatctactccttccaagtcattcagattgaatacacgaacttccttcagaccacacgggtgcatacctctgacagcaagcggacttccatacccgggggttggatgcggaccttttgccttccgctgtttgcgctgtttgctgtgcagaccacgggggcgtcgccatgaatcgctgatggtcttcttcttgtctacaccttcacgtttgaagcgtgcatcttttgatttccggaccttcagaagccggcggatttcatctgccattactgctcactccgtgatacaatgtatatgccatcctggaatacacggggatcccggtcccggatacgggttgcacgttcgatgtttgctgcagtcgaaccgacaacttccttgtcaataccggttaccgtgacctcatcacttccgacttttaccgtagttcccggaagaattcgtgcagaacggggatatttttctccaaggaaatttactatctcaagggtctctccaacaaccttgatctggattggaaagtgactgtacacaactttcatactgtacagataacccttggttactcccgtgcacatgtttgagcagtgacttgcaagtgtccctaccattgaagtgactgccttcttttgtgattcggtggtgaaccggacatcttcagagccaatggtgatctcaatacccggataccacatatcacgctgaagattccctttgggtcctttcacatgaaggacggtcccgtccatcgtgacagaaacccctgaggggatggatactactctctcaacggtcattctttccctcagtatacatatccgagcagttcaccgccgactccattccgacgggcatcatgatgtcccatgactccttttgatgtggagatcatgagcatgccgatattcttggacgggaggtacagctgttcccagtattccatctcatcaagggagacagagtaacggggagagatacaaccgcacttattgatcaatcctgacatgaccactttgaactggccaccacgtccatcttctatccgggtatattccttgatatatccggcttccttcataatgcggaggagctcaccaatcagcctgcctgctggctggacaatacattctgcccggccggtgtcagaggcattcttcagcgtgctcatagcatccgccactgtattcagtcttgccatgaaactcccctcagttcagttttttaaagcccattttcggtgcccattcgcggaaacactgtctgcagaagaagatattgtatctgcggacaagtccctgtttccggccgcaaagcagacattcgtgggaaccacgaccaaaaatcttggtccgttctttcccagccttaatattggccattactgtacctccacattatagcgatccttgaggaagagcttcgcatcttcaacagtgaccagctgcttgaggggcagcttcttctgctggatgtgtcgtcttgcaatccggacaccatttcttttaagaacaacggtaacatcaaggccaaagataccgacttttggatcataactctgaccaggataatctgtgtgttcttcaataccaaaggaaaagttaccctgtttgtcaaaggcgcgggaatttattttattctcaacgatcttaatcgaagtttcaaggaacttttctgcagcctctcccctgagagtaacccggcagcttatgggtgcacccttccggataccaaatgccggaagagtctgctttgcaacactccggaccggagtatttccggtgatctcggagatgatacgctcggcattgaccagtttgtcaccagcttcaccaacacccatgtgaacaacaaccttgtctacagctactgaacgatttgggttcattcctcaatcccccagcgatcaattgcgggtgactcccggccgaccatgacgacatactcgtcaatggtttcaaaggactcaccagaactttcatccttcaggatgacacggtttggaaggctgcccggaaccgggatatgctcaataattctgccgacaacaccggagtgttttccaccgatgatcattgccatattaccgggctggaatgggaagtgatcgatgatctcgttcttctgcccttccttcagggagagaacaattgaatcacctgatttgtactgcttgtctgtcagaacatttgatccgtctcgaagattcagctgaattctgccaccttttacgatggtcttgttggtgatcttcacaaggcgtgaggatgctgcatcttcatcgatcgggatggttacatgacgtcccttcttgtcacgaaggatgcggtagtgtttcccgctcttcggtatggaaacgatgtcaaagatgccgattcccatatccgggtgccgtaccggtctgccatttacgataatctcacgctcacgaagaacgtgttttgcttccttcatgttccggacgatgcccatctggtcacgtgcccagacaacaatcggaagtgcatttttgttatgcgggcccggggaggtctttgtgacaaacttatcagtctttcgtggaattccccatgactttggtgatacaacccgcttgaggtgatgtcccatatttactcaccactcagtttctgttcacgtcgcttgtcctcaagattcagatcggttatcatcacattcgatggatcaaccggacggggaacttctgtaccgtctgccttcttgactgatactccatcaaccacaatgcgtgcatctctggtgatgacatagtcaaccagtccttcagttccggcatgatccccacgaagaacctttactgtgtcgcctttgataacgcggatgctccggcgcttgtacttcccctgcagttccttggaaagggctgcatgcaggagtgagccacgcatatgatgcggagcattgtaccgggcttttctctgttttctgggttgactgctaattactcgtaccatgcacctgtcctcacacaataatggtggccatagagccgatacgggggtaccggattgcgacttcacgggctaccgggccttttatttcagttccccttggttcgttcttgtcatcgacaacaacgactgcattatcctcaaagctgagacgaagaccacttggacggcgaatctctttcttctgacggataacgacagcacggacaagttttctccgcatgtcaggggttcccttctttactgagacggttgcaatatcggcaagaccgagcttgggctgacgacgacggacaccatggtatccgaagacagacacaacctgaacaacacgtgctccggtgttgtctgcacaggtgagctttgttccggtactgactgcacgggggacctttatcccaagacccttcatgcccggttcacctcaacaactacgtaggtttttgtcttggagagcggtctgcactctgctatactaaccatgtcaccaacccgtgcatgcaggcatgggggattgtgtgcatggatttttgaactccgtttctcgtatcgctgatattttctgacaaaatggaggtagtcccgctgaactacaaccgatcctgtcatcttatcgctcacgaccttgccggtgatcacctggccgcgcaccggcaaggtgccgtgaaacgggcagtttacgtcactgcagtccttttccgggaccgggacgtttaatccgatatctcttgccattatgagcctctatctcttgattcgcatgttgatgcgtttctcaggtgccatgtcgagcaccgcaccggttacatccacacgttttcctgaaggaagggtgaaccggaagattactcccttttttgccacctttttcactccggtcccggtttttacaaagaccatatgtctggtctcacgaacaaccaggccggagattccgttcaggtactgattttgtgcttgttccaccctgacatccagtccggtcagttcatgccggaggatgttctgcggggtgatcatgcatgcattctacggttctgctcggttttcatccgggcgatggtccggcggatttcacgaatccgacctgcattttccgtggaacctccggcactgacttttccatggtattggatcagttccatccggagtttgtcaacctgttcaacaagttctacatcagagagctgtgaaacatcccgtgcacggaagattgccatttactcttcctccatgaagtcatcaggctcattgacgattgcatcaagatccagatcttcctcgtcatattcagaggggattctggtgatatgagccatattccgctgtttcttggtgactgctgcagtaacctcgaagtggtcaggaagctgtgcacccggtggaataaggcggacctgaacaccaatgacacccagtttcttgatagcaactgcgtatcccttgtcaaccagtgtgttcaccggatcaccggaatgcttgatgtatccttcagtgaacttctgaacacgaccacgtgctccggtaagcttaccggatatgacaacctcacatccgagtgcgccggaatccataatacggcggagtgttgaagaccctgcctttctgaaataccagccgcgttcaagagcacttgcgagccgctcagccattatctgtgcattcaggttaggattgtcaacctgctgaacctcaatctggggagattcgacgccatatgtagttgcaagatcctgcgtcagggttctgacaacctttccgcctttaccgataacaatacccggcttttcagcaaagatcgtcacctgagttccgagaggggtccggataagatccatgccaccatatcctgcacgtttcagttcatgaccaaggtgcctttcaacacggactttcctgacaccgtctgcaacaaattttcgttctactgccacactatcaagcctcctgctcgcggacgaccagctcaatattcaccgtctggcggtctttcggagttgcacgtcccattgcacgtggcataaaactccttcttctgatgccgcggtttgcagatacatggacgatcctgagctgatccccttcaagtccgttgtattctgcattcttgcggacattgttcagcagccggagatagacgcggcttgctttctgtgggtaccggccggcatcccagccgacaagacccttccggtgaggaacattccggttaaaccgcttgaacggaattggtttctgaagtgcaacgacaccctcaaggtatgcagctgcatcatcaagcttcatgcccctgataaaacctgcaatttcaattgcatgctttggggagatcggagcttcgttcacgcgtccccgggcaatatccttcccggttacctggtttgaataatcaaatctggccatattcatcacttcagcggaacgaacttactcgacctggttgcaccaataccggctgaaccgtgggtaacccgccttctggttaatgcaaactctccaagataatgaaacactgattccggctggagttctacgcggataaactccttcccattgtagatctcaatttcacgaccgatcatctcagggagaatgatcatatcgcgctggtgagttctgattctcgatccattgctgcggatatcagagaggagtttctcttcaccgatagtccagccacggagaactttacgccgtgcacgggagggcatgacaggaagcaggtcctccagactcattgcacggagttcgtcgatcttgtagccatggtaggtaaattcctccttccgtcgtggcagtttcttctgtaccttctttgccatcccgttcacctccttccagtccgccgggcagcgatatgtccaacctttctacccggagaggttccacggctcaccgtctttggtctgccagcgtgctgatgccctccaccaccgaatggatggtcgatgacgttcatggcgaaacctctgacacgtggccagttgcttgcagtattcttcatcttgtggtacttcttaccggcctttacgaacggcttttcactgcgtccgccaccagcaacaatgccaatggttgcacggcactgaccgttgaaccattttgttgagccacttggcatacggactgcaacacgtccttccatcttgtcagtaacggttgcctgcacaccacttgcacggacaaacttgccaccgtcatttggataggcttcaatattgcatactgaagacccggtcggtatttcctgaagaggaagagtgttcccgtttctgatctctgcatcagctccccaggtcagcacatctccgatacccataccctcagtgaccaggacgtaggtgttttccccgtctggaacgtcgaccagggcgatcggggtgtgacgtgcagggtcatgttcaatatcgatgatcttgtagctgacggtctcccctgcgcgacccaggtgtttcaatgctgctttgtaccggtgtgagggtgcacgatatgtcgggccaccatgtccacgactctgtgtagtaattctatgtcccatgctggcacctcacatgattccaagccggctgagaatctcttcagcagctttcgggtttgaaaaactcaccattgcttttttctctccccggttgttcatcagggtccggacacgggtaaccggctgatcaaacatcttctcaatggctaccttgatctggcccttggatgctttccggtcaacaataaactgcagctgaccgtcacgctcaacgatcatgctcgccttttctgttgcatatggatatttcagtatcattactgctcgcctccgagttttctgactgcatcttcagtccagagggtaaggcgggctgaatgcgtacctggtgccagaagttcaacattcaggttgtcaacaaggcacacatccactccggcaagatttcttgctgcacggagccgttcttttccggtaacgataagaagactctttcgctgtttataccggcggccacgaagctttccacgacctgcacgaacttttcgggagcgttctgcacgctcaacatccccgtaaacaccaacggcacggagtgctgcgattacttcctttgtcttcttcagggattcaaagtcgccggaaaggacatagggaagtgaaccggtgaatacatgaccccgggaacggaccagttcgggagatatcgttgcggctattgcagagttaagagcttttcgtttctctttctggttgatgttccgaatcagaaccttctcaacttttggcggatgtgcttcacgtccaccttttgcctgtgggacttttgctgcgcgagaactgtttttcagacgcggaacatgtgatacaccacgaccactcccccagccgactgctgaggcagtaattcctgcatacacatatgctccgtgtggctgataacgccggctctgctgggcgattaccgcttttttgataagatcagggcgaaattccgagctgaagaccggaggaagttcaatctcgtgtgccacagatccggtaagtgtcaatacctgtgctttcatctacttcacccctgcttggactccaggctgataaacccgatagttggctcacgaatcttgtgttctccgaggcgcattgcatgccggatacggacaagacgctttgaaggtccgggaacagaacccttgatgagaacataccgtgcccgcacttctccgtaattaatgaaaccgccttccggcgtgatttctgctccatcttctccgattttaagaaggcgtttgttaaactcagttctctgatggtatcccatctgacccatcatcggaacctgccaacggacatggtgcggagtccatggtccaagagttccaacatgccgctccttctttccacgggagtgctttctcttccgaaggtgaacaccccagcgctttaccggaccctgggttccttttcctttcgtgatggcagttacatcagtatactgaccgactttgaagagtgaacggatatcaaagtcctttccaagcatggagagaccatattcaaaccgctctgtcatggaaccaccatcaatgcgggtttccatgaggtccggaactttctttggaacaccggtaagaacggaaggacgagtatacgtcagcgcgacgacatccacaattttgtctgcttcaagtgcttcgcggatcttcttctctgcctcttcgcgtttgtagttctttgaaaggttcagtctccggctcagttccttgtcaaaggagtcagcccagacttccgtcagaacgtggtttccataggtatcatggcgatagacacggattgcggcaactcgcatatccggaacttcgatgaccgtaaccggtaccatgatatcttttccctcattcgggctgtgggcatggtcatcgaccataatgacatgagtcatacccactttgtatcctgcaaagccctggagtgcaggttctccctggtacgcgggccacgcatgatattttggaaccgggctttttgccctcttcctcgggctgtatgccagagaacccatgcgaggtctgtgaattgttggcatgtatcaatcagtccttcttttctgtatctggggacacaccagaattccggtatgcttcgatgcaggaaagagacacgggacatgagctgtatatgcgctttcgccataactgctgcatgccggacatacgatcagatctcttcctacctcatggagttccgtttcggatgtgcagaatactgccagaatgatcctcacatgtgtagacagatcggatttgtatcatccagcgaccggtctctcgtaagatgcgtgatacttcggcttatcctgaaaccaggatccgggccgcatcgtccacccttgccgacatcacatcccactctatcagcccattgcaattaaagcaatttttgaccgcttcatagctaaaagaagccagaatcagtacattcagacagtcagggaatcaaatccctgctatcgaggcttccctaatattcatcaaaatgaggtataaagatttggctgttattattcaaagtagaggtcaccatcatctttcaggtacacctcaattttttccctgaccagccgggatttatttttttcagggatttcttcacgaatacggttcatcagctgaatattatcataccggacctttatccccagtttttcagcttcgttatagatcttctttgaagcctcaaaaaggtcagaacccttatctattgtacagagatggcgtgcatccaggctgtaaaaaaaatccagagtctcacgcgcccgcttgatattctccatcgcagacttctctatagtgcagatatttgcctttgaagtccggataatatcagcaatctgctgctgggtaagaccagatcttcggtacctgagtacctccttctgccggtctgtaagtaacccttctttcataaattcagttgatcactaaaaatttaaactggtttcgttaacctgctcaataataaacaaatgttaatccaaacatcccttcctttttaaataaaatataacacgcgccatatgaggtattttggtaaaaatcgatttcacaatatttattatgatattttgtcaaagtatcgttgaacacacgaaggtgtagtatggttgtaaaagtaggaattgcaaaactcggaaatattgccagcggcgttatggcagaacttctcctcgatgagcgtgcagaccgtgaagatatgcagaccttcatggcaacatccggtaccaagcttcagcctgaagatatcgaccgtgttgttaccaacatgaaggcatggggtccggacttctgcattgtcgtctcaccaaacggagttctcccaggtccaaagggcgcacgtgaagcacttgcagctgcaggtatcccatgtgttgtcattaccgacgatatcaccaccaagaaggaagaatgggaagcactgaaggcaagcgaatttggatacgtcatcatgaagggtgactccatgattggtgcacgccgtgaattccttgaccccatcgaaatggctgactacaacggaaacctcatcaaagtactctccattaccggagcattccgcaaacttcaggttgccctcgatgaagtcatcgaccaggtaaaagcaggaaagaagggcaaggaccttgcactccccaagctcgtcatgacatcagacaaggctgttgaaggcgaattcagcaacccatatgcatatgccaaggcccgtgcagcatacgaaatcgcgcaggcagtagccggtgtcaatgtcaagggttgtttcatgaccaagggctttgagaactacaccccaatcgttgcatccgcacatgagatgatgcgccaggcaatgctcctctgtgaagaagcacgcgagatggaaaaggcaactgacgctgtcatccgcaagccgcacaagaacgatggaacccgggttgcaaagaagaccctcatcagcaaaccagagtaaattaaacccttacgggttctttttttccctgatttacgcaccattattcgtacgccacagcccaccgagatcttccggtaaagtcagaatgaccggttcaagatgaagtttttccataaaagccgtgtcagatgttgaaagcgaattgggatttatgcgtgctatgagaatggcaaatgcagaaaaaaagttacgttgattctcctgcccgaagaaaacagacaaattccaagccccatgaccgatatcctgatagaaatcaagaacacggacgaggtcatcagaaaatgaacgaaccgattttttaaaatctgacacggttacaccaggaaggacacaccgtatctccttttctccgaccggaacaggatgagcataccagaaaagattcaatccatccagaaatcgtttcgaggttacttcatgcgaacagagatcagaccaccaggaacgggcatgcttctgaaaataatcccgtgaaccctcgagatacttcatcggaagagtatcaggaacaggatcagcaagaccctggagatgagggtgaggaagtgatgcaccggcggaggggagaaaattccagtttattgagacatatccggatcgattttccaggatctgtatctgggccatgagcgcatcatgaatctgatcacaggtgaaggagcggacctggtgctccctggtcatcacagtgacaatgtgatatgatgcgaagggatagaggttcgggaatgttatgctctcaccaataatcaggcgggaaccatcaggaaacaccggcgttacttcagttacaagaccctgacaaaagggacacccttctgaagaataaaccggaatatctgggactccgataccgcgtttcaagcgctccggacagatgcgtgatctcataccggtgagagaatcagtcctgaactcaataaatccgctatcgtgttcatggcgactggtcagaaacatttcatcttcccaatatcccctatgaggatatcagttttaccctgatccaggagccgagtacatattcagcacaatgaattttcaaagaattatctaacgatacagacaggcacagggcgattaaaaaaagatatggtatatgattttacacgacgtatttgccgagaagacggatggagtttaccatatccggaccaagtggtgaaccaaagatgatctgggtaacaccggattttaacaggtcctcacacttttgcttgacagtgtccggatttcctgcaatggtaaatgcgtcaatagttgcatcatcgacattctcacctgcggtcttaaaatcaaactttgcaagtgctgcttttatgttggcaaccttggcaagatcgagtccatgacgctggaggagaggttctggtgaaccggcggcgatgaaggcggcaacaatctttgctgcgttccgtgccttcttctcgttcatgtcgatagacattgcagtgtatgcaccaatgtcaaagcccttcttgcctaccttctcacaggctgccttgataattgggatggcaacgtcgaagtccttcgggttggatgcgttaatcagggcaccgtctccgatggttccggcaagttcgagaacttttggcccctgggccccgatatagactggaattcccttctttccaggaaggctgacaccggtgagctttgcgccatcgtagtcaaagaacttcatcccactcttctttacttcttctccgccccagagtttgcgcatctgaacaactgcctcctcgagacggccgaccggcttctcaggattgatggctaattttggaagggttgaaaggtcaccaggtccgatacccatgactgcacggccatcggatatctcattcagggtacatgcaaatgaagccattgcagccggagtgtcggtgaaggcgttcataattcccggacccatcttcagggtggtggtttcctgtgcaattgcggcaagggtcgggtagcagtggcggttgttatagtggttggtgatccatgcaaaatcgatatctttcgattctgcaagcttacagtagttgactacctgtttgacggtaatgtttcccggaacgaattctattccataactcaaggttaacacctcatttctgtattaatacccataccggtaaaaatattatcatttgatattggatattttgagattttttgccagtgaaaagggaaaatcagatagaaatgacccactcattgaaaaaattactgcaatattctggataacgcatcggtttctcttagataatcgcacattatgtggatatctctagtacaggaatcaggaacacttgtatcagatgaacagaatacatatacacagatcctcgtgagcaagtacgggcgtgatataacactatgagactgctgattctcgggcttgggactgcaggaagtaagatagcagacgcaattatccggccatctggtcactccgcacgatgttcagaccttcatgccattgcagttgacaatgaccctgaaattctggagcatctgacccatatcggagaggaggcgaaattttactttcctaaagatgatatcgaagccccggaattactcaccaccagatttaccatcgatgaagtaaagtcgaaactgaaaggatttgatgtgggtacacacgatgccgttctggtatgtgcaggccttggaggaggactggtaagtcttgttccacacctcgtctcgattatcagggagacaatgtttgaacctgtctttgccctcgtcaccatcccaacagaagatgagggggaatcacgtcttttcagggccatgaagaacctgcaaatgatccggcctctggttgacggagtcatcatctttgataatcaactctggcttgacaaggcacggggagaactagcagaaacgacccttgagcagcggcctgtcggaattgcagaaaaattctggatacctggaacatctgaaaagagaggtatcgagccatatgatcttgttaaccggcatattgcgcgaaggattcggttactggtgcatgcaggtgagatacaaaagggagttcctcagaccgtgctggactcccgcgagatactcaataccatcaccggcatgtcatacatcaccatcggccttgcagaagaagagctgccggagcatggcagaatcagcattctcaggcaacgaagcgaaacccgtgtcgggagacaggaacgggctgcccgcatagtcaaacttgcagaaaaggcagtgttccgcgacatatcatcatattgtgatttttcaaccgcaaaaaaggctcttatcctgttatcaggccctgaagaagagttgtccatgaaaggctacatggccgtgagaaaatggatcgatgaaagtattgacgggtttgagatgcgggcaggcgatataccggtctcatccaggcagtcaaaccgtgtttcagttctcattgtcttctcaggtctgaagaccgtcaccagagttcaggaactctatgaacgctttggacaaaaaagagatgatcgtgaataattatcgatcgacgacacgtgaaaaggggatcgtaccggcaccaatctcagtctttaatttataacctgcttccacggcgccacctatcgaattcatgccagaatatgacaccagtgagatccgatgaggatcggtgagcagattaaaaatcctcccctttcccatcataaggggaaaccgaaacccgcaggcctgcatctcctgaatgagtgtttgactgcgctcctcggcagcacccgggatctggcggacatttgccagcaatattcctgaaccggtgttgatatactgattgatagaagtgagaccagctccgaggaagagctgaagagagtcgaccgttgagccctggtacccgataatattcataaaccgaaccggttttttatcttctatctgaattgtcccgccataggctacctttaccgggatgccattatgctggaaaacgccgtccatggtaatgctgcagacggtcagaataccggtgtgacccgaaggtacccgtggatcccggtcaattaccgaatatccggagaagaaactacaccctgcatccctgactttgtcaaacatctgtgagactggttcaagtatttcatcagggacaatggtgagattatatgccacatccccggtagaggtcgctggatcaaaggtacttctaaaggcgagccgttcaagttttgatattacaaacccgatccgatcgtcaacaagagcacgatcggtctccatgatcccggatggggtgagaatccgtccctgattaccaaccttttcagtaaaaccccgggtatcaagatacctcaaataatactgaactgcacggtctgtcatcacatagccccgttctgccagcatttcagacaggcgtttggctcccatcggttcctggtgttccttgaggatgcgaagaatttcgatgtatttatgctcggtcttgatcatcgtgctgttaccaccccatgactgtcctgatacctgccggaatacccggcaccaggtgcgtctacctgttgaaagaccatctgcactattctgtcgccttcctgcacagatacatcttctgttccacaattatacagacataaggtgagatgaccgcgaaagccgggatccacaaaccctccactgatgaaaattccgcgccgtgcaaatgaggaacgacaccggagtgtggctgcaatatcaacaggaagttcaacccattccttacttgcaagaagcgtcatcatattcctccggatgacggagggttctgatgctcgcaggtcataggaggcgggttgctgactctcctctgcataaggcctgagaataatacctccttcttcagcagataactggagacgggcacgaattgactgcgatgacaggatcatatcctacaggtgggagaataaagattatcagcctatggattataattctgaggggatccatagggtagcggatatcctaccgggcttcggacccggagacgtgggttcgattcccactggatccgtctcttttacaacgattttcttcggttgctgtgacttcttctgcgaggccgttgtctttttgataagaacataaaaaggcctgcaccggcaataaggagaatcaatgttgctgctacaggaatgaatggaaagggagcagaggaaccattgctgactgtggcaggattatgaagcactatggtatttgggttcgtttctgtatttgcagatgttgaattgggataatagcctcctttttctgctttgatgcgatacatttttccttcgattgcagggagcatgcatgttccgttcagatccgtctcacatgagttcagggtttcctgggcatctccaagaagaaacactgacacttcccgcaacggagcaccatacgcatcaatgacctttgcttcaaggtcgatgaactcactttcaagcactactacgagttcactagtctctttcccaggagtaaaggtcagggtatttcttttatagccatcacggttcacaatgaattcatatggcctgatctcaagtgacgggatcatcagcctgccaaattcattggtatcaccaatcatgatcccatccatctgaacagatgcattggacaggggtttttgatctctgttatacactgaaacaaaaatagtagattttgcctttaccagggggaaatcgaccacctgatcctcaaacgagatggttctggaaacatgtgacggctcatacccgtcggcagagatatcaaaaatatgttctacatttctgctaatatttgagatgagtatcccccgatcattcgttgttccaatcttaatcccatcagcctcaatatgagctgactgaatcggatatgaactcacagaatccagcactcgaattgagattctgtcatttcggacaagggagtactggactgttgttgaatcccccccggttacaacggtatcatgaattgcctgaaaattcggggcatttatctcaaggctgtatacctgatctgcccgtagaccaagggaggccttcccttcaaacccggaacgggcctcatacctgattccatcctcgctggtcacaacgatatatgcatcctgcacaggtatgagcgtgtcagcatcaaatacctccacatggagagtgctgtttcggaccagaagcggaaccagaatcgcagtatcattctctgtcggtgatccggtccattcggtatagccaccctttacaaccctgatatttggcagatgcccttcaaaactcaggttatatgcgccgttcacatcagttttccctgcaatttttccatctgcataaattatcgcttcaggtatcagcacagttctgtcagactgttcaaatacaatgaccatcaccgaagagccggaaacaaggcacagtgacaggaccagacatagactgacgatacatacagcggaaaaatgcatacctgatatagtgtgttggtggttctataaaaaaaggatacgggataacccgttattcaagatttctggatctcccgggtacccactctctgacattggggacacggtcgattagcataccctcaaccataaccggcctgagtcttcgtgcttcctcaattgctttttcaagccgccatttccggtctgcatagatcgtgaagatggggtcacccttggagaggctggtgccatgtttagcatgaagatagagccctgctccatgatctgctggcgcacctgcggtccgtgcaattgttatcagggaatggttgttcagatcaataacatacccggtactgtctgcacggaccgtgtagaaatgctctcccaccgttattttttccgaacttacatcaggtgttccaccctgaactgcgatgatatcaaggaattttttgagtgcctttcctgaccgcagtatctcaagggcaaggtttgccccctcaccacggtttgcttttcctgcaagttccagcgcaatacccgcaattacacagctcttctgaatgagtgaccggggggaatcacttccttccagaacactgagtgcctccttaatctccagcttcggcccaatcgcccggccaaccggggcatcaccgtaagtcagagcacactcaacccgcatattgagccgttctccaagatcaatgaactgccgtgcaagttttttcccttcttctatggtatgcaccttgcagtattttccgaccggtatgtcgatggcaacgacatctgcacctactgcaaattttttggccataacacttgcaatcatctgaccgatctgatcaatcttaaaagggtactcctgaatgatgatcttatcatcagcaggtgcaatattcgtggcacctccccagacaatcaccccaccggtctttatggtcatctcctgaacttctgatgcactaaattcaaccggggcaagaacctccataagatctgctgtccctcctgctccggtaattgcccgtgaactggtcttgggaattaaaagaccgcttgcagcaataatgggaacgacaataagtgatatcttattgcccggcacacccccgattgaatgtttatcgacgattggtccggcatggaatgagagctggtcacctgtctcaaccatggcacgggtaagtgactcaatctcatccatgtccagttgattgatataggaacttacaacaaaagcggtaatttcactcggggagagtgtatcctgaacaatatcagcaacaatagccctgatatcctcacgggtcagtttctctccttccatcttcttttttatataatcaagagaaaccggacggtctgcaaccctgacctcgacaacctcattttcggtaagggtcagttgctcattcgtgtgatggtacacgccaatacggccctggtcgataagagtgccagttgtctccacataatctacggtagccttgccggtaacaggagaagagatgacaatccggtcacccgcaagcactccgagtgattttgcatcattatgatgtaagagaattccccgtgcagcaatatccaccagtcggacggtaagtctcatacccggtatatgcagcctgatcctatttatggccgtaggatttggatatagagatttgaaaaaaaggaagtgttagttggtttagttccggcgcattacaaagaatgcgactgcaccaagacctgcaagggcaaccagtgcaccaaatcctggggactgctgggtcggctcaggggttggtggaacggtggttggctcaggggttggtggaacagtggtcggttccggagtcggggtttcattgactaccggtgcttcggttggtgcaacagttggtgctacggtcgggatagctccagcctcaacaacgttgaagagtgcagtctcgacggtgttggtggtcacaccagagacacggacgatgtactcatccggcttgaatgtgcttgcatcaacattgaatgcccacttgttcagaccatcagtgccctgctggaccttgacagttccggttgcaccgctgaactcaccactctgtgacttgtcggtcggcttgaatgaggatgaagttacctcgacaagcagatcattgtcgtcatacatgaggttggtggttccggcgatctcgaacttggatcctacagcctgctcaccgatcgggttgatggtgatcttgggctcctcaacgaggaactgcatcttggtgtaggtatcgtcgaccattggagagttgattgcctggataagtgcttctgcagcgtcagttccctgaagtgctccggatccgccaagcttgaacacctgggagttccgggtcgggtaggaaccatagacgtactgtggctcgagcgggttgtctggatagacatcaaactcgttgttgtacatcgggtgctggactacgacgaagtactgtcctgcatagagggatgaggtcgttgcactcttgatctcgtgctcgaatgacatgtcatcgttcacggattctgttgcatagagaaccttgttctttccaagaatccagattgcgacacccttggacggatcgccttctgcagtaccacggaggtacatcttgtcaccctttgcaacaacacttgcagatgcggttgcctggatgtatggcttcttgataacgagagatacggtgtcgtactgtgcgtcgctcaggtgatccttgtcacgtggagcgctgacagcatacacggtgtaagttcctgcatcaatctcaaggttggcagtctgccacttgaactcgtaggtgtcgtcatcctgaacgtcagcctgatcaaaggatgccggctggtcgttgttgacttccttacgtggagatttcagcattcctcctctggttgggaggtttggaccggtaatatacagataggtaacgtcagtctcggagttggtaccggagagtttgacttcctcaccaaggtagtagctctggtctccagatgcaacgatagtaacatcgcccttttctaccttgacatcgacctcatcagacttgtactgacttccggatttgcgttctacacggatagtgtacttcttgtccttggtgtccttggaagtcttccactcaacggttctggttccactggagttcagtttcacaagtgcgtagaacttggttccgtggaattctgggtcgtcggggacatcctgcttgatgctcttccctgctccaccttcatactggtacttaccgatctcgtatggtcctgctgcagcgtcctgcttgacatcaacctgtgcgtcgaggatcataggtggctggtcatcaggctggccggtcattgagccagttccctttgcccagacatagtactcagcatttgggacaccagtgatggttacagagaaggggttgccacggactactgtgtccttgttggcttcgatcttcacctggtcggtggcgatctgaacactctttaccgcagagatggtcttcccggtgtagtctgaaccgtcgggtgcagtatactgatccttcatgccgttggcgttacactctgcccagacggtgtaggtacctgccttatacatgcggttcccatacttgtcctcggctgcagtgttccatccatcgttggatgccggctcagtgtgcttgttgtcagggcttacccagtaccagagctgctggttgacagcaagattcgtcagcgaaatttcctttccgttgtttccgacaaggttggtgtagacaccaccatctgcactctttactttgatcttgaaaggtgcatctgcaggctggtaccctggacgggtgatgatgctctgcatgttggtctcaacgacaaagttcccgtagttgccgaccggaattgccttaccggtgacgtcttcattcacggagccgtcccagatcttcaagttcagagagggttccttgatgttgaatgcgagcgggccttttacgctgccgttccactgataccagttgccggtctttccgacgaagatatcaggagaaacataaaagttctgtgcattcgtaacctgctgaatatctgcaggctgttcagtctcggtgttggtacctggctgccaccatgcgatctggctggatccaccggttgctgcagaaacatcaagtcccttctcaccaaggaagacttctcctccggctgggatcttgttgattgctgcagatgccgggaatgcaacaagtgcaagtgcaacaagcaccatcatgacaactgcaaattttgcgttcattacatgtcctccgaacaaacgttcgattcgcatctatccgccgatcagccattgttattggtgactgttcaccggacagatactctatactccgagaaatcgaagtatgactagatatttgtgaaatgccttttatatcctttttggtatggaaccctttgaaaataattatcagagaccccattttttcatattctcaaaatttcatcggatttcctgatcgccatccggatccaggttaacagaaccattatgtatcatctcacaaaggcatcttttcgcgcattgaatactccgatactcaggggcattcttcagatgtaaaaacaattatatggaagaaaagataacatataaaggcttcagcccgatagtgtagaggtcaatcatacaaggctctggaccttgtgacagcagttcgaatctgcttcgggctatcatttttcaaaatttttacttagagaatatattccccataccgctgtatgaccagtatggtacctgtccagatcaagaactgcaggatcggtgattccaccatgttcaagcaaattcaccacctcaacaattctatcctctctttttttatcagtccccattgataacaattttaaaaagagtatcagatgtcctccttgcttgagaaaaatgagatttctcaaggcaatttcagcctggtcacgctgggcaatatcctgaatgagaagatccaccggctcgacgaagggaagataccgttcgggatatcgtgcatcttcaaataatgggataatgttttttcgtgcccgggcaaggcggataagacttcgtaccggccggggagagaattccactgcatacacgacctccgcgtaatcagacaggaatgagaccgttgacccggcagcggcgccaagatacaaaatacgggcgtttctgacaggaggctcaccatgtatatggcataatgcagcaaccttactgtggccaggatcccatatccgcataccatgatacacacggtctccaggtaaaactgctccgggagataataattttccatcctgccagatcaatccgtcttccctgcccggcatatcttctcaccagcttttctgataaactcatcatctaaagctcccctgaaataatctatccttgcagcgattgccagctgacatgcaagtactctgctcactcttcctctgacccgtcgttttgcatgatggactcccttatactggtatatgataccatgtttcgggggatttgtcccgcttgtcagatgcataaataatgatggtccagctcccagtacctgaattgatgctgcgggcataccggcaagatgatatttacttcccgctcctgcaagaagacgggcactcacaagtgggccgcataaggcagacatatttggcaggcattttgttgcgtaatcacgaacattctgtgagataagagtccgggattcacggaaccgctggatatttcttgcaaggtgactcatcggttgcgtctgatcttttgccagactctcgataagagaactgatattcctttcatacccggatagtccggcggggtgcagtgcaatatagtaatcctcaatcttctccgacagacgggcaatagattgatcaatctcatcaaggattctgataagatggatgagtgctgcctcgtctttatcacatcgctcttctaggtcacgaatagtcagcccgattgcaatgtcctgaaggattgacagatatccattccggtcaggaacaaacccggcgctgactgcctcctcccaaagaggtaaggggagtaattccgatttgccacggctctcgcgtatagtgtcgattatatccgccaaggatgaagtggcaggagtcaaaaaatccgccggtccctgttgaagggcctcataccaatactgaaatgcccgattgacctgatttttggccatttatatcaccataccccaaatgaatagagtattaccggaatggtaacaacccccatgcagggaacccgtgagaccgcaatcatctcaggtatcatcccgattcccgttgcaagtatgagaattaccagcccgaagggaccggtcagaataccacacaccagaacaagcgtgattgcaaccccggtattcagatacgaactattcagaccggataaggatgaagccgtcccggcaagacaaacagtaattccgtacgcaccaagggcagcaaggcatgcgattgtcagaagaaagaggataggtggcgtttcaaacccggaaaatgcggccatcaccccgtttcgcattcttccaatggcaacaaaaactgcgataccaataatactgtttgcgagagttgaagcaccaatcgcagcaaggtaatgaaatctctcctgatcatacggaatccagccggagattacggtattggcacttgcagttgataagccaggaagccatccaacaaccagtccggcaagtgtcccgggaagagcagcacgagccacagtcctggtcgggattgagagacctgaaaaccgctgccttggaatggtcccttcagacgccgtcagaaggaacgggagaccaaataaaccggtcaagagtggcataaggatgctccccgctccaagggtgttccatgagaggtactcaaacctgaaggcaaagagaccaagaatgccagacacaaggcagatggcacagagccaacctgcggcttcactgcgcacgatgaccatccccattatcaaaaccaggagtgaaccggtcaggatatcaacagaggactgaagaaaggggataaaccatagtgccgcaagagccagcgggatagcaaagatgactccccatagacttccaagggctgatattcggaccgcttcttccccttttccatcaagcgtgagagagtgagccggcagaaccgagagggaggtcccgtcatccggcaccccgaggaatgtagccggaattatttcaagaaacgaatgggtgatgagcgtggcaataaggatcgctgccattccctccggtcccaggagaggaaggagagcaggagaaaatccaaggagaagggctgctatcatgtttgcatggattccaggggtcagaccactgattatcccacacatcatcccccccgttataccggccaaaacatgaatcatctggttctcatggatttaagtgtatagaacgcataaaatatccgcatccgttctgaataagaggggccagggggatgatatgcggattgcaattacacgtctgaaaggaaaagagggagatgaccaggcaaggtgcgcacgaagggggcatgattgttacccggtctctccactcatcggagagatgaatcctgaccagattgatgcatttattcaggatgtaaaggacaggagatttgactgtatattctttaccagtgcccttccggcccaccagattggaccatatctgcatgacctgccacttcccagggtcatagcaatcggtccgcaaaccgcgaaagctctcagagaatttggcatcatgtgcgaggtgctccatgaattttactcacgggcattcgttcccttcctgggggactggatcgtagggaaaaaaatcggcatcccccgatctgatgcaccaaatgataaactcctccagggaatacgggatgccggtggttttccaattgaatttcaaatttacgcactcatcccgacgtatgaactgctcaaccttgacaaggcggagggcattctttttaccagtgccttgtcatttaaatcggctatctggaaacgccgggaggatcttatccttatggctatcggagaggtaacagcgggggccatggaggaagcaggccttatgcctgatgtcgtaggggatggatctctcgaagggacactcgatgaactcaatctctttcttctcatgaatccgggtggataatggaacgatcctcttcatttctggcacatattgctgcacaccagggatcgatcatcctcatcgataaaccccgtgggccatccagccaccaggtagcagcatgggtccgggagattactggtgtatcatccgttggtcataccggaacccttgatcccccggtctccggagtacttgtcattcttctcgggcgggcagtccgacttacgaccattctgcatcaggacgataaggaatatgtggcactgctcaggctgcagggagatgtatcagatgcagaacttgctgaagtcattgagcacttcaccggaaggatctaccagcggccacccaagcggagtgcagtaaaacgtgcccttcgaatcagggagatccatgaactggagatgctgggaagggacggaagacttgttctcttcagggtgaaatgtgattcaggcacctatatcagatcactgtgtcatcatatcggcatggcctgtggggtggggggagcgatggttgagctcaggcggaccagatcaggtcccttttccgagaaggattgtgtcacccttcataccctccgcgatgcagttgagaaggcacgtgcaggcgatgatacgtatcttaggaagattatacgatcacctcttgaagcattgcacgggtttccaaggatacagatgaaggaatcagcggctgatgcgatctgtcatggtgccagactctcttcacgaggcgttgtcagccatgatacattccagatggaggatctggttgtcatgttggccggagatgactttatcggaatcggtgaggctctggtttcaagttcgcggattgtgcctggtgaaaagggactggttgtcgcacctcgccttgtcatgcaggatatcggagtataccctgcagtctggaaagctcataagccaaagagagaaaagtcttaaaacaactgactgccaacatatgtaggcatcttttatttgctgaggtagtctagtctgggaaggcgcaagattggaaatcttgtgggagcaatccctcgggagttcaaatctcccccttagcgtaaatttcttttaattctgttttagatctgtcaagatatttttattgtctccacaatgggtttcgagagttagaaattttaggatcgattgggactttttgtagacactctcttcattttttgttccttaccttttgtcctgtgatattaatctctggaatatcaagaatggaaattctggctcatgtaaaagaacatttaggaatcatatagatatagcattatacgatttatattagattggaagcccaatacaacctactacagagaaactggcggagatgagagagacactatgcatgtgaatgtgagcggctcttacatccaaatccaacaatatggaaggcttgacaactcaagaaaaaatatcaggtgactgatagaccagactggtaatcaaacgcttttgaaaacttgactatccccccacttacttttgccttatctttcattgagtttgttgctgatgtcctgttccatgatgccccatcatcacgggcttccatgatatcagcagaaaactctgttgccactgtcccgattgcataccccagaccagatacaggatttggtgtgagatcgatctggtatgatagagcggacggaactgatccatcagcggctactatcctggctttcgctgacgttgaatactgggcactgtttacattgatcagtgaacttcgtgccctgaccgtattacagaaggccggaactgtagccgaagaaccggatgaaaacacacaccggccgataccattcgtatctgaataattcccacctgagtttatgaccagggattcgtctgctatgaggtgactgccatcgatactctcatatgttactactttgtctgtttcaaagttatagagaccctttgtctgattcctggaatcaaaatcaagagaactgctcagcatcagatgccccccgttcgtcatcaatgaatctttgtagagtaaggacgccattgtctcgttcggtccaaagattcgatcttctagtgttccggatgaaattgtccagtcgaacgaggtatcagtgctgacgtatccgataacgtcgatcagagtcgtgatcgatatctgctggttttcaggcgttgcattcggaagaaagtcggcccctattggagatgatactaaaaataatgccataacggcaattacagctattcgtatccaaaacataaaccccacccaccaatgctaactgtatagttgtcaggatagtataagtacctaatcaggtactaaaaaagaggaaaactgagataattatgtatagtacttctctatctgtgattcatcaacatcaatagtttggtttgtttctatgatacgatagggcccggttgttttgacatcatatggggaattcgtagttgcataggggagagtaaaggtgccattctcactctgctgacggtaggtgaaatgacggccctggttcgttacgatggggacttcgatggttccggttccggggatggtgtatcccttgacccgttcgaagatcttgatgttgttgagggttacgtcgccagggaaggtttgggttccattagattcatagatgagacggtagtttttgagggctggggtgtcggtgatgggggaggtgtacatcagagatattatctctgtgttagaccaaggttgagacaagaattgaattgtctgggtctgatcaatgggatacatcttttgaaggagaggaacttctttacctgacacgattgtgctttgatattgaataaccacactgccattggcgtgcacatacgacccatcattagcgtgaagcttaacaagagtagtattaaaaaatgcgggtttcattcctagcatcggagtaagtatcgaagaggttttacttgctcgattataaaaaacaaaataataaggatcttcatctggttgtgcaggtatccatttttgaatcatgggaaaatcgttaaataaatactcatttgtagtaataatatattttccatgtaattgtgaggcgatcatttctgcttgaatattagaatcagcaaggaggaacttagctacaggaacgatattatcctgaaaaggagaggttgcaggaattttatgagccaagacaaggatccagtgcccactagtccaccaagatattaccgttgatatattttggggatatgaaaaagattccttatagattgaataataatcaggaacatcggtgttattttgctgagataaccattttaatgattgaatccattcatcatttatagaatctttaggagtttcatttaatccaacctccatcgcaacaggaatagagagaatagtgatcatagttattaaaaaaccaatgcaaagaatacccttgttattaataaaaattattttccagaaaaatttatttttattatctttttgaattttatgatgccttacctgaattttatcgtacagtgcggaaagaaatactccagccaatatgacaaaaatttcaccactataatattgaaatcggacaactagtaaacttattactatatagactgatgcccatataataacagctaaattaagtggatttttcgtccgataaaattggaaacataatattaagaatccaaaacaggaaagaattgcagtaatattaaaaacttttagaaacgtgaaaatattggatgattgcatctcttgaattgttacagaggtaccatttagcgcaaaaaatctagttaccatatttgtaaaactattagaaatttccgaattaattaaaattaataaggccgagaaaacaaaaaatatcattaacaatattcctgtataaaaaaacctattttttgcaactatgaatctcgataatatataaagaatacctgattcagcaattattcctgcaggaatgaaaagatgaattatcgaatattgccctaatgaccaccctgatacctggatcccgcttaaagcaaataaaattatgaacaggccaaaaattatcccattcattacaaaaatccgactatagtctgatttttctgtaataagaactggtaggaaaaatgtaaatagggcaataattattgcaattaaggtacaagtaggcatcgtcataatagccaggtaatagagaatgccacaaattattgaaagtactattaccagattctggattttagaattcccaaaatagtgatgtgaccaactctttgtagataaaggtgccttccatttggttctgttattattattagcattaaagtaggataataagataaaataactgataaaaaaagaagaagttacgacaacctccattatatgatgatcgacatcaccaaaaaatgacctgaagagggtttctcccccgacaacacatattaagatcgcagcgaaccagccggctttaacatcccaaattattttaccgaacatataacagagaggaatgagaaccatacccaaaatgacaggaacccatgaaattgcacgaataatatcgccctggatagaagcatttagtattaaagcaattaaactgctaaacaaagggaataccggcccccaatcaacaatcttaccatttggataagataagaatggatcaaaccatgagtaattcggaaaatgatgaattatttgttctacttgtcggacggtataccaaggatctgtcgatgagactatgggctgtatcgactctaggagaaaatccgatggcaataatcgaatccataaccctaatatcacaaaacaaaaaacaattatacctaaaaggatatttaaacggctaattgaggacaaattcatttctatctcaattatttttcatctacaacatcattaaatcatctttcgatgagtgcattctctaaccaaaaatcagactcattcgttggaagaattacagataatggatgtaataattccagatatggtaaaaaaaagattgaattatagatttactaattagaaagtaaaccctgattcgtagttaaaggtcttctggaagttcttgataccgccagtgacggatgcagtgtccttccagttgttggttgcggatggaacctggttcttgccacgtgcttccatgatggagccgccgaagagggtctttacagttccgtctgcaaatccactgccagagttgctgtcaggggtgacggcgatctggtagttgagtgctgctgggatatcaccggttgctgctactgcacgtgctgcacccttggttgaaacctgtgcactgttgatgtttacaagttcgctctttgccttgacgacattacagaatgccgggaagtactcggtagatgctgctgcaaagacacagcggatgctgtctgcagtcttctcccagttacctgctacatcaagagtccactcttctgcaccaacgaggtgtgcaccctcggtgcttgcataggtcagaaccttctcaacttcgaggttgttcaggcctttgcccttgttgcgtgaatcaaagtcaatgttctcattgagtgcgagtttaccaccgtttgaacggagggtgtcagtccaggtcagaattgcgatctcttcacctgcataaagcttgctgtcgtgaattgctcccggaatcttcactgtgctgtctgcatagttaaagtttgcctcgatatatgctaagtaatttgcataagtggtgctaccgaataattctggatccatgtagtttgtgttgacatctactggaacatttaatttagtaaggtagaaaactccaccgatgttcttgtatgataagtaatcagaggctgcatttccatacagatttgcccactcagttgctttggtctgaagataattaagctgtgcaggggtcaaaacaactgcattgcctgcaagggcatcaaagttgttattatcaaagattactccctctgcaacagaattctgagagtcaatggtccactgcatttcgctttcctggctgactgcgccagtgacatcgataagggtgtcaatggtaaagatctggttctctggaacctgctgcgggagccggtctgcagatgcaaatccggtgactgcaacaagtgcaaccagtgcaagaacaattgcgtatccgaacttcacgtaaatttcctcctacatttcatgctgatactctcagcatcaacaaaacaaggttgtgtgtaacctcataaatagtttcccggaaaaaatgtcgttgattgacgataaatctattcgttttgatctttttgggaaaaaccttttctgataaaataacccatatttcttctaaaatctcgagattattcaattttttcaggaatcgtaaaatcatataaggacagccgtgtcgaattctcatttccatcgccctcaactatctctgagcgagaatcagaatgacatcatatttgagcttcagcaatttttccctcttcaccttcaatcacaatgactacatcttttgaagaatggttttgaacataccccgctaattcaagactatcagcaatatcctcaactttatcccggaaccctactctttggactttcccttttactgaaatgtgaaattgtttccttattgaatcggacatgatatacaaacaccaatcaatttatatgtacactactctgcatatatcttctgtgcagcctgaatctatactctcttcaaccataaatggcataaacaatacacaaatgagacaaactcacttcctcgcaaccgtcagatacccactatgacacacctttgtcgaaggcctcgtccctctctcgctccggtccatctcccgcataatactctcatgggcagtaacctctgaaaagagcccggaggccgtatcaaacacaatccccatctgttcaaagaacggtgtatagcagaccaggtacccacctgaacggatcagggagaaagcatggatgacatgctctttcgttactccaaggtcaaggtggacaatatcatactgcccgtccatctccaggacatcccggttcaccacctcaatatttgaaagcccggtctcccggatactctcttctgcgatccggaaaaactcctcccttcgttcacaggtcgttacctttccggcaactccggcaaaaaagactgccgcaactccgctcccggtcccggcatcaaggacatgatcatacttattcatcgcagtcaggccaatcaccagccctatatcccggggaagcatgggtgccccgctccgttttgcctgctcaaaaaagtctgttgcccgaggaaggcgtataaccagttcctttccggatttggtcctgatgatatcgcccggctcctttccggcgatgtgggagagatcaaccatcccaagatcggtcccgagactcccctccccggctcggacaacatagatcttacctttcccggagaggatcacccggtctccggctgctatcatgaagacagacgaaggatcgcttctgcaatatctcctttcgtctcaacaagagctgcctttgctgcttccggtgtcacatgtgcctgcccggcaacaagctccacgtcctcatcaggaatgaccgcttcagcctcttcaaaccgtggctcaccggttatctgccaggtgacagtgccctgcatcttcatgatggcaacctcggcctggtcaaacacataccggcccttaggggtggtaatgacaatctcctgcacatcttcaatcggcttgatatccatcccaagctgtttcatcatctgtttcatcttgcgggggttcattccaggtatcatgattattcctctttttgtatgccgtgtctgaccgatactgccatcccggtttcacaggccatcatctctgtgccggatacgacagcctcgccaattgcgataaaccgtccgtctccatcgatcacaataacctcatcaccggcgtggatacccggatcagcatcggtaacatgcctgcagaagaggttttttccggctgcgatgaagtttaccacatcctctctgagctcgacccgacccgtttggccgggcagggcttcatggagccgctttcccccggcaagcccaagggtcagacgaccgtcatgagcacgaagggttgcaaggcgttttccatcaaggagaacctgacggactccgccacgtctggatgtgataaacctgcaggaatcaggaaataatagtacacctatacccctgccaaactggagatcagcgatggtcctgacacgactgagcatattgctgcgctaatattcggttgacatcttcgataaatgcacgctcttcttccttaggtataaaggctccggcagcgatccggtgacctcctccggaacatccctcacgtccctcgcatgccagagtgagtgcctgctggagatcaactcctttactcaccacctccggacgggtccgcatggatatcttcgtcatcgacgggtcaagggagtcctcgcacatgatcaggataggtttttctggattaagccgggagagtgccattccagcacctatgcccacaatagtatccgggaaccgaccgcctacatgaatgtagagcatatgggagagctctgtcacacccgtttcggtaatatagagcatgacctcgcgtatcttgctccggtgattgcggagcatatgttccgcctcccggtaggcaaccatccggtcaccacgacaaatagcccctccaagctcaggtcgctgccacctcccacatgaattcagcatcgttgcaaattctgaggcattccgaagtgatgcctgatgccggtcctcgtcagggaagagatagtggtcggcaaagagtcgcccggtgtccttcccatgagcaaccatctgttcaatgactgcacagcatacctgctgtttctgatcaaatgagagatcctcccagaccggccaccggtttggctggatgggggtaataccgatccgttcaagaaacttcccggcaccatccgggtccctgcttactccggggatatccatgtcatctgaatatgccagggactggggaagcggccgggtggatatcccgtaaatattgagatcatgctcccagagctccacagtaccctgcctgaccccatcctgcaggatctcccgtgccgggccggtaaggcagagatgctccctatccatcatatcaccgatattaccgatgattgcaagcttggcaagatcagtattgatcgagtccagctcccttgcaagcagatatgagacccccgcagcactcatcttctcatgtccatggttcagacagttcacctcgatgaagggatcgccatgttctgccggctggctgacatgatgatcgatgatgatcgttctggagggttcaagtcccttctcaagaagcatctgctgctgaccggagccgaggtcggagaatatcttcagggaagagtcatccgggatctggtcaagggtcaggggatcgagctgacggacaaaagtagtggaaacgcggatgccatcacggctgagagcctgtgccagtatagcctcactgctgatcccatccgcatcaatatgagagatgatggtcacctcctcacatgaacggactgcatcagcagcagccctgatatcctcaagaagactcattcaggtactatatggaggtatgagaaaaagaggaatgtgcagggagtaaaatagtagaggagagagaggaggatttcatgactgtcatcattcaaggcagatcatttccggatgacctgacacaatatgcagaatttatcgggcagggattattatcaccggaagagatgcgacggattgatcagaacgcacaggcccttggcatcagtggactggaacttatggaatccgccgggaccggacttgcgatggctgcacgccagtatcagcccggaaaaatactcattctgtgcggaagcggaaataatggcggtgacggaatggtggcagcccgccatcttgcaggtgaggcagatattaccgtcttctggtatgactcgggaagacagaccgactcaacaagaacacaacttcagcgtcttctctcttgcagtgtcacatccatcccattccgcagcagggatgacctgattgagcatacccggatctttcaggataccgaccttatcattgatgctcttcttggaaccggaggaacgggttcggtccgggaacctgtcagaacctgtatcgaatttgcaaataatgcaaaggcaccgatcctctctgccgatctcccatcaccaggtatcatcccggataggatctgtgcatttcatcgggcaaaaaccgaaggagcacatatctatggcatcgggattcctcttctcgctgaaattagtacaggacctggagatcttcttatcctccggaaccggaacccggacagccacaagggcgtgggaggcaacatacttgttatcgggggtggcccataccagggagctccctaccttgccgggcttgcagcactcagggctggtgcagatatcgtccgggttgtaagcccccattacctgcctgaaccggatattattcatgttcctacagccggtgatcgaattaccacagcagaccttgccaccatcatacccttgtgtaaacaggctgatgtcgtcctctgtggcccgggtcttggtcccgaatcccatgatgtcatcacatccctcgccccctatatcagaaaaggagtctttgatgctgatgcattgagagatcctctccctgttgcgggagaatcactctatacaccccacgcaggagagtttgcccggatgtccggccttagccctggaaagacaccacgggagcgggcacatgcaataatgaaggcacagatattagggacagttctgctcaagggagcggtggatgtcatctgtgacggatcacgggtcaggtttaaccagaccggcacacccgccatgacgaccggtgggaccggggatgtgcttgccggagtatgtgcagctctgatggctgttgttcctgcatttgaggcagcgtgtatcggagcctatgtcacagggcgcgcaggtgaactcatcacacagacctgtgggtatgggatgacagcccgtgacctccttacggcagtacctcaagtattgttcaggagcacttctgagagagaataatgccggtatttactcatcttgatgatgaccgtgccagaatggtggatgtatccgcaaaaggggaagtctaccggaaagcggtcgctacaggaacgataacccttcgtcctgataccctgtctgcgatccgggatggcactgttgtaaaagggaacgttcttgcaactgccagagtagccgctacacttgcgattaaagatactccgcggcttatcccgatgtgccatgcaattcccgttcatgggattgatatcacctttgattacacaaaaacgggaatcacagccacagttacggtcatatctgccggcaaaaccggggttgaaatggaagcacttgtcggtgtgagcaccgccctgctcaccatctgggatatggtaaaatctgccgagaaggatgagaaagggcagtatccggttaccggcatctctgatatcagggtacttgaaaaagtaaaacaggacctgtaaggcagtcatcaagagcagatatatatcctgtatgagagacctgtaatggactttcgggatccgtcccgttaggaatgtagcctgattcaggctgaacctggtgaaccgcatgacaaaatctatgtatgcatatgtcagggatgcatggaagatccctgatgataccggagtcaaagccctcctgtgggaacgaatgcaggactggcgccgggaaggaagtattgttcgtgtccgcagaccaacacggattgatcgtgcccgtgctcttggatacaaggcaaaacagggtatcgttgtagtccgtgtgaaggtccgccgtggaggccgccgggcatccagatatgttcgtggacgtcgtactgcacgtatgggtgtaaaccggaagaccatggggaagagtatccagcggatcgctgaagagcgcgcctgccggaagtacccaaacatggaagtcctgaactcatactgggttggagaagacggacgtcagaaatggtacgaagttatccttcttgacccgcatcacccgtctattatcaatgataaaaccctgaactggatatcaaaaccagggcaccgtggccggagtgagcgtggactgaccagtgctggtgtcaagggccgtggcatgcgcagacgcgggaaaggtactgaaaagtgccgtccatctgtccgggctaatgcaaaccgggccaaataaccttttttaaatgcacgtctttgacggttgcgtttttccttatccttccggaacggtaagtattgccaggtatgcacgggagctttcttcacttgggttttctgggtgcgttgctgcgagcatggcaccggtaaacaggatatatgacatcccggtctggacagcacgatatctgacggaggttccggcccgtcttctcagcagagaagcaggaagatccgtacaggtgaatgatctcgtgtatgtacaggcgggagatgccggatataaccggaatatcctcactacgcagggcgtccatgtcatgaccaatctgcatacaactccgaaggacgggtttgaccggtactgtgcacaacttgccgccgaacgggagattggggtggatctatcagtcagacccctcattgaacttcgtgatggtgcgaggcaaaaagtcatcagaagatatgaagagatttttacgcttcagaaccggtatgaattcccgattgtgctgtcaagtcatgcctctgatataacccatctaaaaagtccccgggaaatgatacgactcttttcacttgtatggaaggatgagaacctattatgggagtctctggagagcatctgccggataaaaaaccggaccggaccggttgtggagatataaatgcgtcttcgcccgtccatgcgtgaaaacttcagatatgttcttgttcggattacttcggattctgtttttgaatcgcgtgatctgtaccgatcgattgcagagtcggttgtcagcctgtatggtgatcgtatcacggcgcagatctggccgtctgtcatgcaggtatctggttcttatgcaattatcagatgcaggcgcggtcttgagcacgatcttgagactgctctctgtgcgatatcgcagattcagggcacaccagcagcaatacacccgctcagaacatcaggaacgatccggacactgaaagaaaagatgccgctctgcaccgagaaacgaagcgcaaaagccgtgatatcaggagttccctgtgatgttgttgtttctatgcagggaaggatagatctcaaagaaaaggggatttatcatgagataccacggtacataacagaagaagatactgaggacctgtactatgatgaataataatcaggccgcatatgatcgcgccattactgttttcagcccggatgggagattataccaggttgaatatgcacgtgaggcggtcaaacgcggcacaactgcagttggaataaaatgccaggagggcgtcgtcctgatagttgataaacggatcaactcccgccttcttgaggccaattcaatagagaaaattttcaggatcgatgagcatatcggagttgcgtcatccgggcttgtcggcgatgcacgcgcactggtcgaccgggccagaatcgaagctcagataaaccgggtcacctatgacgaaccgatcgatgtcgagacccttgcaaagaaacttggcgaccatatgcagacctatacccagtttggcggggcacgcccctatgggactgcactccttattaccggtatctctgacggccagttccgtcttttcgaaacagatccgagtggcacccttcttgaatacaaggcaaccggaatcggaaccggcagacctgccgtgatgaaactgttcgaggaagaatacactcacgaatgttccataaaggatgccattacccttggtctgaaagcacttcatgaagcaacggagggaaagttcgacgtgaacaccgttgagatcggagtaattacaagggaggaggagcagttcaggaagatgtcacgtgaagaggttctgtcctatatcggacagccacagtaactggaacagggaggcagaccggtgatatcactcgatgatgcagttgttgcaaaacttgagagccatggtgagcggtttgagatcctggtagatccggatttggccgcaaaaatcaggcagggtgaagatatcccaattgaggatgcggttgcagcactccagatctttgagaacgcttcccaggctgaacgggcatcagaggagtccctcaaaaaagtgttcaaaacaacagaatttgaaccgatcgcattacacatcatccgcaagggagagattcaccttacctcagagcagcgaaaggtcctgaccgcggaaaaacgcagacaggtcatcacctttatcgcgcggaatgcagttaatccccagaccggacatcctcacccgccacaacggattgaactggcaatggaagaagcaaaagtccatattgatccattcaggagtgtagaggaactggtaaaggacacgatgaaggcactcaggcctcttatcccgatcaagtttgacgaagtcagggttgcagtcaggatcccgccggattatgcaccccgggcgtatggtgagatctcagccgtagctgccatcgagaaagaagaatggcagaaggacgggtcatggatctgtgttgtggtaatccctgccggaatacagaccgagttctacgacctgattaaccggatcagccatgggaacgcagagacaaagatcatcaagtaactataagtgtatttgaatccaacaaaaaaggacatctaggtaggttttgaatatggccagaaaaatggtaaaggcaaaggggagggtatccggctctacgggcagatttggtccgagatatggtcggtttatcaggaaacgagtacgtgatgttgaactgatttcaaaagcaacacacacctgtccccgctgtgataccgtttcagtaaaacggaaaggaacgggcatctgggaatgcagaaaatgctcattcaagtttgccggcggcgcatatgtcccggtcactccgaacctgaaggttgccctgcgtactattgagcggacagtaaaggaggcgtaaagcttctatgcctgggtcgtacaagtgtgcccggtgtaaacaaaaggtcgagatcgatatgaatgtccggtgtcccttctgcgggcatcggatcctttttaaagaacggggagcagcaatcaaagaactcaaggccagatgactctggtcactacttcccgtcgttccactttggcaaccagatcgatagccaaggatctcgcatttgcaaccggggccgggtatctgtcacggggaaagcacggacttcgtgagatctccgatgagcatgaccttttcatcgtatttgagcagcaacgggcaggaatactgatgacgctctatcgtgagggcgaaccatgcctcatgcgaatcatcaaaaagcatgacacgggtgttcgtgaggggcatctgtataggggtatcagaacatcagaccatgaactgggcgggattctcgaggggacatgcaccgttgattatcttgatcacaatgatctggtacttgcctttgacggcccacagaaacggtgcatgacgctcatactcggcagggtactggatgatgcatgaagcaatcttcacctttgaaacacccgataccggagtaattgtcaggtcgttgctacctgaggcagaaaccgatggagcgggcagatcctggggaacaataacagagacgtctgaatcatcatttgaaatccgcatcagggcagaagatctgaccgcgctcagagcggctctgaacacctggctcagactggttcagatagctgaagagatggtacagacaactaaaaaggcgggaagaacaaatgaataggaggagttaaggatgcagaatatttcgccaaaagtgcagaaccagataaatatgcttcagcagatgcaacagcagatgcagaccatcctctctcaaaagagccaatatgaactggctgcgcaggaagcacgaagagcggttgaagaactgaaggaaacagatgactctgctgcggtatatatgaacgtgggaactgttgtcatgcagaaacctaaatctgaagtcatctccaaagtcactgagaagatcgaaacactggagatcaggatccgatcaatagagaagcaggagaagatgcttcaggaaaagtttgaaaaacttcaaagtcaggttcgttcagaaattgagggacgaaaaacccccgacgcaaactgaatccatatcttttttgagcgaggattgccgagccaggtcaaaggcgacggatttagggtccgttcccgaaggggtccgggtgttcaaatcgccctcctcgcattcttcatgaaactgtgccagttgatatcactacgttttttattcacggaaatcaatacttctccaactgctcattatagaattgggattgtggggattgtgatgtggcacatacaaaaatcggaagtgtgtacccggcaacaggatatactcagaattgtccgggtaatagtgctgggagtacttcttgtaacaggtatttttgttggggtgggatctggcaaaccccaggcaaaagaaactcttgattcagggcctgatgttgcaataattgatgcatcagtcaagatggacatctctgaaatgggtgagatcaccttgggaacgatccctgatgaacgattaatcgttaccatcacggttcagaatacggggaaccgggaagctcccggatacaaactccgtgcatatcttgtacgggttggcagagaggatgagatcggaactcagatcgggggtgatattaccgacaccagacttggcgcaggtgagacccggacatataccaagagctggtctctgccaacacacctgaagaggggggaataccgggtcatgatcgtccttgatacaagcagttattttattgagcctgatactgacaacaaccgcatgacaagtcagcagcccgtcgttcccggagcgcttaccggaccggaaggatcaattccggtatattcacctgcagagattaccaagcccgggtattatgtattaaagcgggacatcgacgggcgaaagaagatgaatgtttttgagataaaaacatcaggagtaaccatcgacgggggaggcaatactatcagaggcttgtcatcgggatttaactctggaatatatatcaatgcaggaaccgcaatccgggatatcaccatcaaaaacgtggtaattgagggaatggatgcaggcatctggatgtacaaggtaagtaacagtgttattacaaattgtacaatcagaaacactgctaacatgggtctccggcttgatcaatccaatcagaaccagatttttgataatacgtttgagaagaatgccataggtatcggaattttccagtccaaagataatcatatcttcaataacctcttgaaaaacccgcataatgcagtcgtgaatgaaaatgagcggaatatgtggaacaccgatctcaaatcaggaacaaatatcatcggtggtagtatgattggaggaaatgcctggtttgatgagacgggtgaaggaggattttctgcatccgctcagacctattcccacgaaggtatttctgattcaccctattcactgaatgcaaacaatatagatctctacccactctcccggtcaccctcaaaaccatcggttgctacaactccggtaccaatatatacgccaatcccgacagatactcctgttcaggaatggagtgattcaaagtcagagacccctcctgaagaaccagtatctgaccaggtgagtgagccattaatgccggatgtggttaatgccagtaccgaagaaagcacacctctaccagaacaaagtcagaatatccagactgaagaagcaggaaatacagaagaacctgaaccagcccctccgtcacgtcctctttcaccctatgcagacatcagtgtaaaagagatcacaggacctgaaaccggctgtccgggaaccgaatttaacctctctgcagttattgaaaacaccggcgggtatgatgctgatgcattccaggtcagattctacctgactgaagatcgtcagatagatgggaaagatatctttcttggagagaagacagttcgtaaccttccatcagggagcgagcagactctcacagaatcttttatcatcccaaaattgatcgggctcaaaaattattacctggcaatcgtcacgaacacagataattcagtgtttgaagataaaaaagaaaataataacggatattcatccattcggatggcaatccgggattgttaattactctttcttttctgtactattctctttttcaagagtgattggagtaatattccggaccgttacttcaaaggtaagagcttttcctgcaagaggactgttcagatcaaaggtgacattggttgcattcatatcagcaatagtagcctggaagagttgtccaccgtcaaagagcgttacacgatcaccaacagttgcgttctcgccagccgggataaattcaatcggcatcgaaacgatctttgccggatcatattcaccatatgcctcttcaggggagagggtaaacttctttgtttcattcacctccatgcaatgaagggctttgtcaaagccggggattgccccaccagaaccaagtatcagactgaatggctgaccactcgtatatgaactgtcaaattctgttccattgtcaaaggttccgatatagtctacctcgataagatctccggtctgtgcaccgccagtacatgcaacagcctgggtttctgctggaggtatggtctggacctgttcaggcggggttgttgtacacccgcagatgagtgctgctgcgataagaagaattgcacctgcaataccaagacaggtactgcatccgctgatgctgaaacgtttctccatactcagctcttggaggatggccgggaaaagagttctctcaaaaccctgatactggtggcacgagcatctgttaaaaatccggggtgatgatcaggtcttctggttcatgcgcaaggccgatggcagcaagagaaccgataatccctccaccaccataggtataaatcccacactcacgggcacactggcgcgcctcctgacaggtaatcagactggttcgggcccgaagtccatattgatataataaatccgggatcagaaatcctgtcttaatcgcgatgccccacccgtctgacacactttcatcgccgataaaccggacggctgcctttctgataaggtcggctttttcaggaaccactgccagttctatggcactacaggagttccctgcagtcttctccggaagatcctgccaaagcatggcgatgtgatggccaatgggaaatgtgcccgacaattctgacaggtaatcaagaagggctattgcaagggcaaaggttgccccctcttcaaaccggtcggtattgtcaattccaatgataatatgcacgagcgcctgcgttctgatacagccctcagtcgcctgctcatgcctgaccgtatcaacgttgatgaccccttctgccctacccatcatcccggtcagtgagaatgccggaccccccacggaacggattctctgcacaatttcatccccctcctgccatatcccggttaccgcgacggccgattctggccagagtcctaccgtactctcatactgtcccatccgaacaaactcacgaaggatcgtcccctgacggatgatcctgatctccgggttggctttggcatgatgcctcgcacaaaatgcagcacaggcactggacaggcactcatgcacaatctccaccatatcaccatcgacagcggtgaagatcctccggcatgcggttcggggtatggcactgacagcagcatacctgctgggagcacggccatgaggctgagtgagcaccgtcagacatccctcatcagataaccggacaatccagtcccgtgcagtactccgggggataccggctgactgtgcaagatcatccaccgtaaaagaacccttacggagggtcagctttcgcatcagcttcagatacgaacgtctgcgctcaattaccccctgcatacctgtcacgaattgaaaggatatctccaaggaccgcacttgctgtctcaagcgatccggcccctttccctgagaagaccagatccccggcaagatcggtacgcaggatgattgcatttaaagacccgtgaacaacaagcggatgatgccggggaatgatccgtggtgacagccggtagagattctttccggggattatctctccgatgagccgtatcgttgcatcctgctcttctgcaagcctgattgcttcttcggtcaggagatcaatcccggtaatatcaatatcttcaagcgttatccgctggttcaggaccgtatttgctaatattaccagttttattgcagcatcaatgccttttacatcatacgtcggatctgcctcagcataccccagagcccgtgcctcgtcaagtgcctgcttatacgacagcccctcttcagccatcctggtcagaatgtaattgcaggtcccgttcagaactccatacagggcctgcacctcattcccaccaagtgactcaagaagcgtatgcagaatggggatcgctccggcaacggttgcttcaaaccggaaggaaacccctgctttatccgcctcctgtttcagctcatgataatgcaatgcgaccgggcccttgtttgatgtgaccacatgacaacccctggataatgcagtccggatataggaggttgcaggctccccggttgctgcatctgtcggggagacttctaccagtacatcatagggagccgtccggacaacgtcatcagcagtaatggagacatcgccgcacagtccggtctctctcttgcgggacaggagatctgacggtgagataccatccgaatgaatcattccggaccgtgaatctgcaacaccggtcagcacaatcccgagatcttttctggttatcgcttccaggataccccggccaacagcaccggtcccgataagtgcaatacggatggccatatcagaactccaggggctctatcatcaggatatccttctgctttgacacatcacgaaggatttcaatcgcctgatccatatgttccctgctcaatgctttgatggtacactttgccgagcttcgttcatgtatggcaggcatggcaagactcatccgcgtaacctctgcaaaaccggtactatcaatccgatcaaccgtgtcaccgaggtttgtatgaatcagatggccgatgagaatgaccgattgctgataatgcatccgctcttctccaaatctgatgacggttatcccccgctcctgaaagagtttcaaaagagcgtccagccgctcctgggggatttcaataacaacttccaccccaagggaacccttgtctgatgaaaagtcatgttcatgaatgaccgtcttgatatttcccccggcatcggagatcggcatcagtgctgcaaccagctgacctggcgtatcacggatttcaagtttcatcgagacctgcatacatctcctccctgcattattaaaccaaaattctgcatttttttcaccggaacggggtattatcactggtaatgatcaccgacatcgaaaatccgtcgccaaacggatcttcatcatacagtgttgtaatctgggtcctgtttgtcccgttcactgatgtattgttcccgtaaatatccaccgaaacacctgctttactgaatgaatagagcggatcgccgagcgggatagacatatcatcctgataactggtattactaaagacatgaagaccggtctggctctctattcctgcattttgcagatttattccggcaggcggaagagagaaactgaacgtggtctttcgttcaggtgcaacaaagacctccatggtctgattctgatatccgggctttcctatctcaagaatgtgaggacctgactcaattccgttcagggcgaggggcgttacaccgcgcacctcaccatccagaagaacgatggagttatccggactgccggtcagcataagcccgccggttgtgcgggagggatgagtgccggcaccatacaccgctgcgttatggaccggtaccgcttcgcttacacttccctgatactcggcatttcccagataggatacacgtatatattcagcaggggtgtgattccccctgaaaaattcaaatttccctgtccggtctgtcgcatcaaccgcaattcgctcaaatggatatgccggatcaccatcaggagaagactccaggcttacccgtttgttcccaagaggagagccggatgcatcagtcagtgttccggtcacggtaaaggcgtacccttccggagggttttcaggtgtcactgttattgatatcagtgtctcctgtttatctgcggctgcccaggaacatataaagcacgttaccagaaagaagatgagaagcgggatagagatccaatgccctgaacatatccccgaatagttccccatatcagatttcatgaactgagggattatttcgtggcaaaaatcatgaacataccgttctgaagatcagtgccccaatccaggtctcttgaaaaaatttaaaacgcgaatcctgctttgccacttgttggtacaaattcaggattgcccttctcatactttatgatgatggatgcaaactcctcggctgcctcaaaccccatggcagtgacgatcctgtccttatatacaaccggtttattctgaatgattgcatcctctttcatcatctcacggacagtaagaccaggggccactgttgcaatcttcttctttagtattcctgcttttgcaactacaatcggagcattatcaatagccgcaacgaccttctgtctggtattgaagatcgtaactaattcgatgagatgccggttattccagagatgtacctgggttcccgggcctccgacgatcatcagggcataataatcatcaacaccggatagcagaacatcttcaaaggtccggtttactttcgccttcttgccaaggacgcccattaccactccgacgtgcgtcgatgcaagttcatacgtcaccccggcctcctgaaattttttaaccggaatcaggagttcctcatctctgaacttttcaggaggaatcgcgatgagtaccttcatatcattatcactgttatcagaagcatattaaccatattgaatccttctgctgaaactatcaaattcacagacaacgcttagatactgatgccaaatctcaatatcgcctacctcggaccagaggacctggtaaaagaactggggaaaaaaggcacttcaaccgacataaccttctataacatgaaaaaagggggagtaacattaacgattattgagccctcccgatacccggaaaagttgtcatccctcttttacacggcatcccttgcagatcttgctgtactggtaattgatgccctgagcgcgaagctgggagagataattctgatgctgaacgcggccggggtgaaagacggtgtgttcatcctgagaaattaccttgacaagggacagattgcaccgctcatccggggtactgtcctggaacagtatacagaacttccagatgatccggtcgtgctgcgtgagtggttgtggaaccgtgcaggagaacaaaaatctgcgcggaatactgaaaagggcagtgttcccatcgatcatcacttcaatgtgaaaggaatcgggactgtcattctcggatgtgtgcaggaagggactataaggcgccatgatcaactgacagtccatcccttaggaaagcaagcccagatacgttcaatccagatgcatgatgatgatgcagaggaggcatctgccggagaccgggtcgggttggccctgaagggaattgaggctgacgatcttgaccgcggatttgttctttcatcagatccacgaatcatctcatctctgaagatcactggaaccgcagatatcatcccctactggccacagccattgaaagaacagatggttttgtatgccggacactggatgcagtttctcccctgcagggtatcagcagtgagtgatgcaggtgatttcagaaaaccgaccctcacccttgagtttgagcgggaattgatatacctccctggttcggtcatcatcctccattaccttgagagtgaaaaactgcggattgtcgggaccatcacgataggctgaccctcatgaaacaccccaagcagcctcattttttaccaatatcccatgaggaacttcgggtactcggtatcgatcagccggacatcatcatggtatctggtgatgcgtatgttgaccacccctcgtttgcagcagcgcttcttggccgtgttctctgggatgccggattttctgttgcgataataccacagccggatccaaaaaatccggagacattccgtgagttcggagagccaagactctttttcgcaatctccggggggagtgttgactccatggtgagtaactatactgctgcacgaaagaagcggtcagatgatgcctactcgcctggcggtataccacgaagaccggatcgggcagtcctcgtttataccgatatcattcacaggctgtttcccgatatacccatcatcatcggcgggattgaggcatcactcagacggtttgcccattatgattactggtctgactctgtcaggcagtcaatcctggcagatgcacctgcagatcttctcgtctttggaatgggggagaccgccctgtgcactattgcccagcatgcagatgccggagaaaaacctggagatatgcataatatacccgggactgtctggaaaattccccctaaacaactccatgctcttcatatacctgatctgtgcactctaccggcatatacaaaagttcgtgaaaatcccgatgatttttgtctggcgcatacccttatatcacaaaatcagaacccttttgtgggcaggccccttctgcagcaacatccaaagacagtaataatccagaaccctccatcactcccgttgagtccacatgacatggaccggatatatgatctcccctatacccgggaaaagcatccctcgtaccaggaagatattcctgcactcactccggtcaggttctcagtgatttcacaccggggatgctatggaaattgtagtttttgtgccctttccatgcaccagggaacaatcattcagagcagaagccgcaaatccattttgaaggagattgcatcatttcagaacatgcgtggattttcagggatcgtcagtgatgtcggtggaccaagtgcaaatatgtacggggatttttgtcagaactgggagaagaatggtgcatgcaccgataaggagtgcatccgctgcccggtggtcagatcaggcattcatgactatcttgacatgcttgatgaagctgaaaaactccccaaagtaaaacacgtatacatcggctccgggctccggtatgatctcatcccccttgacacagactgtttcaggcagatttcccgacatatatccggacagatgaaggttgcacctgagcatatcataacgacagtgaccgggttgatgaacaaaccagaccaggaatgttttgaccggttcagaatattttttgagaagaatcagagggggaaacagtcacggcagtacctgattccgtatctgatgtcaggccatccgggctgcacactttcagatatgatctcccttgccgaatatctccgggataccggcctatacactgaacaggtccaggactttacaccaacacccatgactacctcaacctgcatgtatgcaaccggacgtgatcccaggacaggaaaccgggtacatgttccaaaaggggaggagaaaaagatccagcgagccattcttcactggaaaaaccctgcaaactattcacttgttctggaaggtctgacccgtgccgggcgaaaagacctcataggtaatacgggcagatgcctgattccggcacgaaaaacgggggagattagggcgacgcgaaaaaagatcagtccttatgagcattatcagggatcttcaccccgcaactgatgcattcctcaatcgtatctgaataggtccggtatgcatcagcaagtacggtagactgggacgtgagtccggcaatcatgatggcttcaaggatctcatcaggatttgcacctttccgaagagctgcctggacatgataatcagtacagtgattacagcggagggcagcagatacagcaagactgatgagttctacaatctttggatcgagtgttccggtcttcagaacggagtttttatacagcaggtgggagatgagcacttcaggccgctctgacatccgttcaaagatgagtggagcccgtccgtaatccttgcggatcgcctcaacccatccctgtgcagtttcggcagcccccttttcgaggacctctttgatgattttttcaaatccgttttttggtttacccatagaaacagcctgaccaaaggtctgtcctgagagatgtcatacttaccggtcatctcattctttcaggataataatttcattacagcaggtggatctcttatactatgaatggaaaaaagagcctcatcctcatagtactggttctgacctggtgtatgttcctggccgggtgtaccagttctccccctcaaaaggagcctgcaacaccatctccaacaagtaccccgaccccggctccgctcccccccacagctgaagagacaccggtttctgaaccagttcccgaatataccatcttcgatggtccggtggctgagcctcctgcagaacttgaggtatcagtatcagcacgaaaagatccggtgtataaccttatcacggttgtttttgacggtggcaaaggccagcagctggtgcagtccatcaatgtccgggttactacttcagatgggatcgtgaccgaactacctcttccgccaaaccggggtgcagagatcgaatttaccggttcaaaagcggttgatcgtgtgcaggccgctgcatattacaaaaacggggcatcctaccttattcttgaccagaatgtcggacagacacgggcaggtattttgaccgcaacaccaacggtgccaagtgcccctgaaacctcctcgaacagcttgtatgatggtccggtaactcagccacccaagaatctgatggttcaggtggatgttatcaaggatcccgtgtaccgggttattaccgcaacattcaggggaggtcacgggcagtcccttgtcagaacaactcagatacatgccctgctctcagatggatcagaagtaaccaaagaccttgccagcaatatcgggagcatcgcagagattcaggggacagcaggaaatgataaaattcagatcgtggtcttttacaagaacggtgaacagtataaaataagtgagaaggtattcggcccaagaggctgattatctcttttttcgaatgagtgccacaccaccaagggcgccaatcactgtgccgataagcaggggactttgtgtcggttcgggggtcggtgtcgcctccggagtggtattcaccggtttcggagtctctattacgatcggaattaacgttccaaacaccggaacagtctgtccgatcatgacagaggtttcaccattccagtcctgatatccgggaagtgtgagttgtatctggacaggtcctgccgggagatccggtatggtaaccggcgtgattcccacgggagcaccattcaggagaacatttgccgaagaaggttctgatgagacctgaagtgaaccggtggtgatcggggtgagggtcactctgatcttggtgttcatatttggctcaacatatacccgttcaaaccagtccttgtatccagccagggttatctggatgttacgatacccggcggtgatgtcacgaagaacatgtatgcctgacttgtcgataaaaccggatgaaataccatcaacaataacctccccgcctggcgggcttactgccagggacagagtaccagtctttgccgggggaagggcagtcagggtaccacggatgatattactctttcctggctttggagcctgaaccagtgtctcattgtatgtggtatatccgggagcggtgatcatcagctgataattcaccgggcggttacttgtttcggcctcaacaagcagcgaacctttctggatggtaccgacaaattcaccattgaaatacaccgatgcattctctacatttgacctgatttcgtaatacgaggtcatagcaggagattcttcagcaactcccggacagaagagcgtgagtaatcctgcaatcaggaataaaaataatatattggatttttccatagtcattctcatagaacttttcctcaccatatttctcctcaatctaccatgaacccttatctcctgcgtatctgcccatatgcaaccataactccggcaacaatgagaagcattgttaccagaaccgacggaccacctgaagcagaagaaaccggtgttttggatactggaaccagagttcctgagaggacagttgtctccccgccggcaacgtcagtttgtgttgaccagtcctggaatccggaaagacgtaacagtaccacatgtgatccggcctctacctcaactactgcgggagtaatgcccttgtacagatcatccacataaatctgcacatttggaggagatgacgagatatccagtgatcccatcaacttcctgctcaggtctattctgatctcggcagggagaccatctgggacatttacccacatctcctggcttgcataccctggaaatgaccctgttacggcatgttcaccaactgtgatattatcaatgatcagaacccctgactccggaacctgtccagccactctgccatcaagggcgatatccatgccgaccgggcttccatcaacatgcagggttccggtcgcctgataatccccaccggtcagttctggagatgctatccctgctaccggaagaataagatgaaaaaggagaaagcaggagaatactccggccatcacaagaaaatgaatggatctcattgctttacaggctccgtcacatctgctgtaaccaccggttcaggtgccggagtggaaacaaggactgcctcaactgaacccaggctcccccctagcacagacacattggcaacccagtcctgatacccggccttcctgatcatgaccgtatgttcaccggttgttatgtctttcatgcgtaacggagtcagtccgaccatccggttgtcaacaaagatctctcccccatctggatttgagtaaacattcaattcacccagcggtgaagggatcatctcaacccggtaggttgtagcggcattgtcatctacatagagctgatccgtgatcgtctgatcacccggtttttgcgcgttgacgacatacaatccccgtggcaccgtgtatgcgatcaggattcctgaatcaggagttgtacccatacttttatcatttaatagaaattcagctccggcaggttcgctgataaaccgtaccatcccggtgcgttcatatgaggtcttactcaggtctatcttgtatgcaatcgtctttccaggctcggtctggacatatggccctgcatagggcagatacccgctgtactccatccggacattcttccatgacggtgcaaccgtcgtatcgaccgggattgttaatttcccgtttgatataaaccccatatagagggtatcaaaatagacccgggcaccttccagatctgatctgacttcaatataaccgattccgggagatgaaaaccgcttctcatctccgagtgcctgacagcagaatatggtggaaaagagcaccagacttgtcagtaacatatgccagttcacttcacatcaaccccttatatgtgagcatgggcgatgaacgctcataattctttggaatagtcatcctcatacaataatcatgcaggggaagagaaagaggaggtttacggatttaaaaatcagagaaattcagataatgcatgacttcaagctggtccagaaaccggtcatcagattgtaccaggtcagcgatggcactgcctggtttatctgatgatacttgggcgggagattctgtcgtcatggtaagagcatggaatacaggtaaatccagaaacccggactggtgcgggatcacggtcttggaaggggagtaccacacagagggaacatacggagcatcagtgtaggaggacatgaatgactgcattatatttcacctgtgtttttttgaggaggatacggaggttcggatcattcgatcctgctcacaggtcttcctgtgacatcaccatcgttggctgaaactgcagataagggttgaataagaaattctgttgaatccgttcagactgatttcgatacggatgatcctgacccggagggatcatgcagagaaaaacattccgattgctggatcagcacatctgtgcgggttgaaaatgactgaaacaggtcacagaatccatctagatctttgagccattagagaaggtattatctcgaaatggtaaagtaaaaactatcaaaaactggttgcaaccagttgcaacaccataatttttgattttttcaagagcggatattctccttgtgcggaggttaaaaataattatcacctgaaaaccagacatgattgtatgacggaggaagtcctaaaaattcagtcagtgcatcccatctcactcatacaatgcctcataccttttggtgccctaattggtatgatctcgggaatttttctcacactttttggttttggagttttttggcttcgttttccatcccatttgggtctccaagagatttttgatcctctcattatctttgggacgataaccggggcattttttggtgttgtgatgggtgtgatcagttcaataatccttggatcgataatcgccattatattcaatcagacatgccgaataactggtgggctgatattaaaggtaaaaaggggagaggatctaaacgagcattccagtctctgaaaacggctttactttcagcaaaatataatcccgcattctggatggccggatatcacagacatcggcaattctgatcccggcctcaatctcgatctccctgatctctgcagcataaggatcatacggaagttttatccttgtgccgtccatctgcacaacaaccggaataggtgaggtcacttcatggatagcaggcacgttctcaaggatgatatccataagtcgggcaggtgtgacagacaggggatctttagcaatcccgattcgcttctgatcaataacgcgggagacctcctctacaatctcatcaagtctggccagctcatgcggttccttggtccggtgcataaacctgccaagaccgccgatatatcctgcaaccggtggatctattatcttcatcaaggtttcttttgtcggaccaccacagacaacaatcggcacctgtatgccccgcctgaaggtaggcatcttctcttttatacaggtttcaaagttgccaaagaggtatattgcaagatcatgctcattgatgatatcccgctcctcatcagacaacagaccgattcgtttgccaaatccgcgtgcaagcccgatcatgttggtctttgcaccggctgtccggagatattcagcaacatcacatgaggcatgagggagatgatgaatctcaagtgacatcgagactactgcaatctcagtcccgacaagcggggctggtttaacctcgccggcaaggggacgggagactgtttttaaaatctcaatatcttccttcgggattagagcctggagaacgacttcctgggcaatcatatgtttctgaatgatatacccgcccatatcctcgataaggtccaggatctcatcatgacgaaagacgccccccttgtaggttataggcaccaggatcatgatgcagcctccattatcctgaactgctcatcaacaagaggggtgacatcttcaggcagagtattttcacttgcgacaaaccagaacctgccattatgaaagttctgctttttcacccggaaaccctccggacagatgacctgcatggagtagatgagatccttaaagagcccctcggtcggatctgcaaccgccagatcttcaatgccggatgaggccgcatccccggaggtcagaatctcgatggtaaaccggtccggctgtgatacctgatcttttccataactcttccagaggatttgcagaagatctgcaaggaacgtctcatctgcgattgccagagtaatcttttgcccatcataggtaactccagcaagatctgacacggtaattgttcggggcacagttcgtgtgatccccaccgccacaaaaacaggaacagatggatctataaaaatccgaagtctctccaggactttgaggagattatgatccgtgatcaccgttgaagcgatccgccggtagagctgtcctccaaccggttcggttgagtctacctcaaaatactccagcgtcgacataccaatcagctcttctccacaaatcctgaagacaataatgcggctccgaccgaaccgatgtactgggaatgatgaggaacaacaatctcggtctggagcaggtttcccatggcccgtacaagaccctggattagtgacgtccctccgaccatgacgaccggttctttaatatctatctcttggagttgctgctcaaagacctgttcggcgacagaatgacaggcggcggcggcaacattctcttttgagtgcccttctgcaagggcatttaccaggctctgtgtcccaaagacgatacagtaactgttcattgggacatcttctcccatccccttcatggctaacgggcccagctcggtaatatctactcctaaccgttttgccgtcatctcaaggaatcgcccggatgccccggcacagatacctcccatggtaaacgtacccgggataccatcaaggacagatatggctttgttatccatacctccgatatcgatcacagttgacggaccatgctgacagtcggcgaggaagacagcacctttactgtttaccgtcagctcttcctgaatgaggtctgccccgatacgctcccctatgaggaaccggccatacccggttgtcccaacagcatcaagatcctcacgtgtgacgccggcttcttcaagtgcaagagcgatgacctcatctgcactggtcagtacttcagttgtcggacgccaaccggttccgatgatctcattgtcctgcatgatcaccgcctttgttgtggaggaaccggagtctacccccatggtaagaccggtctgacgctcacgggctagaagggcacgccgccgtgcaatcgtcgtcaaggcctccatcctcgtaagaagggtcccggaggttgtccgttcggtgaaggagtaactgaccacgggaagcctcgagtgttcatggatgtaccgccggagttcattcctgacaatcgccgcctccgcacatctgaaacatgatgcaataaatactgcatctgcttctgctgaaccttctaccagggcaacggcacgggcgatggcaagtttcagatcaccggatttgacatcaagtccgaaatccctgaaatttctccggatatcggacagtgagagatcagggaagaagacctctgccccaacggcctcagctgctgtgtaaatctctttctggactcctgaatactcaggtccgcaggataactgggcaatacggacagtctcttccttcatgatgaacctccaagaccggtgaggaactctttgaccctccgaacaaagatgatcccttcttcctcatcggcaggatagtcaagttcaaggatggggaccttcttttgtttcacaaggaattccaccagttcatcggttctggcacatcccatacacccaaaagcaaaatccggattcctgacaataatggccgcctcagccctgtcaatcaggggaccaaaaagagacatacgccccctgacaccggatggcacttcaacagcagcccaccgtagccccttctttgcatcatcaggagtcatctgaaggggtggagaatcaagacctgctgtctggatacgttcccgaaccgaaagagcggttcccagaggcttatgaccaaaccgtgcgacaagatctgagaggataagacttgttgccggatagataaacacctctgccattcaggcctcctgttcgatcagttccatcagtcttttcaccgataatccttccgtttctttttgttctgatccatgaaccggtctctcagatggcgattccagctcttcaagtccgattgcgattctcctgataaaacccatctcatattcatgtccaaaatatcctggtcgtgctcccccgagatttgcccggcaccggcggggatcaccgggtggaaaaccccggtcctttacatagatatgtgccggatcaagcgctctgatatgtgcgataacccgttccacctcctcttcttcgccggtgatctgcaggccaaagcaggtctcttttatcatgaccctgcctgatacctcataggcccgtgctgcaatgtcatcgggtgttgccttatacgattcaataaagacgtatttcgtaacggtcccggcatacagtggcggaattgttcccttcatggcctgacctccctgaagaacacaacctctccttcttccagccctgcaatcttttccatatcgatcacggtaccgatgatatttgttccggagaacggttcagaagtcggaccgaactctgatgaaggaacagacctcaccccgacgattccaacccccttacaggaatcattcgtcatcgcaagcacacctgcttcaactgatgaaactggagtgttctcagggatcacatttgtcgtcttcggaatttttgctttaaaaagggtgacttcatcaaaggagaagagcatcggaagtcttccgactgcgtgatacttaaggcctgagaattccctgaaaattttacaggtccggggggcattcacatcatcaagagtgatagatataacttgtttgtcaggtatggtctcgacctctacaagaccctgggcaagtacctcaagggtagtcgctggtttttgtttaatgactacacggtcaggaccgtcaacatcaggggtgagcgtaagatgaagcgcttctgcccgttcccgtgccatcgcaagcggcagtccaatcaggtcgacctgtgagggttcaatctgaatgctcaaccggtcaccctcctgcgcaattttacagagttcgataccatggacaacatggccgacgacggtatgagcaagacttcttgggagatcctgagtatagatatatagtgatccgcggtttttcccggatgtccgcattaacactgttccttcccgtctgcctgaacatgcttcacagggaacatcagtccctgtcaggacatcgcatctgatatgagtgctcaatcgtttgtcaacaataaatacccggttcaggagagcgagaagcatccgatcaacgctgaccgcggtttttggatcatacccatcaagagtttttccttcggcctgaaccctgatatgcgtgatgatgtgcattccctcttcaagaacaactgaaccatccgttgttgttctggcgtcagaagactcagcaaacgaaataaccggctcaatggatataatctgatccgaatcactgagccgatccagaacacccatcccggagatgacttttgcaattatcccattctctacaggaccgccgtgatctgcggcatgtgtctttttacagaataccagaaatgaccgtgcagggtcatatcctccgcatccgagtgccagatccccgcgttcataccgggaaggttttctggaaggagtaaaagatgaggggaaaggaccaaaacttgcaacctgcagatcatgccagcctgattgtataccggaaagaccggtcaggatctcccccgcacaagtcccgggcatagtttccacaaccacttcgccagcggttgtttttataagaaattctttcgtctctgcctgactgacggtgaccggccgtagtatgccaatgcagagactccggtcacggtctggcagaagatcatcaattgtgaatccgtctggtactgtggtgatcgttccatcaaaatggattgtgggcattgccactcctgttactcttgtgccatccgttcccgttcctgctcggtaatctcttccagtacctcagctgtcggtccaatctttacgatcttaccaaaccgcataagggcacaccggtcacagatatccctgacaaaatccatgtcatgtgagaccacgatgaaggtctcttccatctcttcccgtgcgtgcatgatggaatgcttgacatcgaccttggtaatcggatccattgttccggttggctcgtctaatacaacaatatgtggttcacgaataagaacctgagccagagcgacccggtgccgctcaccttcactcaaagttgatggaagacgttccagtacctcacgtgctttctcctcagtaaatcctgccatcttcagagtaatgatggctttccgcattgcaagttcctttggaaactcaagtccgattgcatcggtcagattatccagaatggtccggtgggggaagagatcatattcctggtgcagaagaccaatatactgttttgcccgtccacgaaggtcaaagccgggttttgtcatatcaacccagtcttctccgacaagaacattgagttcaccggctgtcggttcaataacacccgctatcatcttggaaagagtggtcttcccggcacctgatgttccgatgattccaaagatttccttgtgaaatacttcaaactggactgaatcaaccgcttttattagcccccgatcaacggaaatataccgttttgaaagttcacgtgtcttgaggatctccttacccagttcaatctcacagaacttttcaaggtcagaaaatccttccataaagacctctataacctcatccggagtcccgatcttttttattgcaccattttcaagaagaattgccctggtcaccacatcctcaaggatctgggtaaagtgtgaggttacaaccatggacatgttcgaagctttggcagcagcttcaagcatattatgaacaagatttgccgttttggggtcaagagttccagtcggctcatcggcaaagagacaaaaaggttcctttgcaagctgacgtgcaagcaccacccgctgtttttctcccccggagagatctcgtgcgatatgcatcatccggtgtgagagatggacctgatcaataagatctgcagcacgtcccacagatttttttgcaggatatccaatatcctcgagggcgcggagaacattatcgatgacccggtcgttcccatacaacgcaaaagttcgctgaaacatgatcgcatttcgtttcatgatccgtcgtttcagcgcttcatttgcgggatcccagaaatcaatatcctggggagtcattgtcccaccacacaccggacatggctctcctaccttactctgtatcccgacatattcacatgattcacaaagagccatgtggtagatgatctttccagaggtgggaggctgatccacaccccggagcaggtgcatgagcactgtttttccagcaccgctcctgccgatgataccgagtatttctccttcctcaagagtgaaggaaatatttttcaggacctcctttccgtcgaaggccatagtaaggttatcaaccgtgatcaggggtctcatcttgcaaacacctttcgtaaggtatggttagcactgatgcgtattacatctttatttctgcatgtgaattttcacgatcggcaaatccccttcaggattacgacttttccaagacatcatacacaatatcaggaaccatccgaaggtcacgaatacagtaatcggcctcggagatcagttcatgaggtttaactgaaggttgttgattactcaaaatcgcaatatctgcagcacgcattgctttcaaatcattgatggaatcacctaccatcataacaatatcgtattgctgtttcaaatcacggacaatcttctccttgatcgcaggagttgccaccccgaatacccggtcccgtggaatacccagataatctgccatgcgttccagcttcgcctcccggtcccctgatgcaatgtacgtaaaaactccccggcggtgaagagcactgatggtctcctgtgctcctggaaacggagttccacctgccgtcacacagaattcaatgatcataagaccggtatgaacgatgaggccgttatttaatgcaactatctcctgctccttgatttctgaccagataatccgcatacattcctgcatatctccgattttcgcctgcctgtcatcatgaaggatggttttcacagcctctttttcaataaccttcctggtgcaggagatcccaaatgcgatatcgtgatccctgatgaaatctgaaaccagaaggtcaggagatgccttcataaaatcccgggaatggccatgcaggacgcataatacgcgatcaggatctgcataggtaagcatggtggtctcgacgtctacgagcagttcgccggtccgtacatcctttgcaatccggtacgtccgcagcaaagtgccggcactatcaaacacaacagcgacgtgcatgaaggctctatcagataggagttacgcagttaacttttattatagaaagatctatatatattgacaacgcctataatatacgtgcctataacgaagcagccttcagatgtagattatatcaattacctcatcgcagctcgatgcgacgtttcttgtgtaaaagtcgctgattgttattcgacgtctgaattctcgatatcacatgataccttcaatcgattcctaacaagacagtctctaactcctgagacgttgtgggctgaagttgaggcatatgttgacagaaaaaggggctggttggttctggatgacactattctagataaaaaacattccaaaaaaatcgaatgtacatattaccagtggagtggaaaagagcacaaagtaatcaaaggaataggattgattaccttaatttggacagatggaatcacttcatttccaattgattatcgaatttatgataaggatgttgatgataagaccaaaaatgatcatctccaagaaatggccttgacagctttcaaaagaggatttactcctgcctttgtcatgtttgatagttggtattccggaaatgaaaatttgaagttgattaaccgtcttggatggttttatttcacacgagttaagaaaaatcgtatggtcaatcccgatgcccaaggtaatgttcaagtgtcatcattaaatataccagaggagggattagaagtccatttaaagaaatatggatttattcgtctttttcactcactaaatcgtaaaggtgtaagtagatattgggcaaccaattttttgccgatgaataatgaagataggctggttttacaatctatttgctggacaatcgagaattatcatagggctatcaaagaactatgtggtgtcgaaaaatgccaagctagaaagggaattatccaacgaaatcatattaattgctcacttcgggcatatttacgattcgaagtcaataaatttttgaatggtgttactccgtacgatgctcaatggcaaatcataaaagttggaatttcagaatatattcagaacccaaaatatgcgctataaattttttagaggttgttctgcgtaactcctatcagataatacagaaggagaacagataatacccgatggccagatttaggatctgcaaatgtcagggatatgccaagaattattctgataagaaaagataacaagagatatgacgcttgaagagactgccggaaagatcagatccatggaaataaggggtgctggcaggattgcgagagctgctgccagagccctctatgaacattccatggaagcggaaagcgcagatctcgcccaatactgtcagaggatgtatgcagctgcagaacttcttgtttcaacacggccgactgcagtctcacttcccaatgcagtcaacctggtcatgaaaccacttaaaaatgaatccgaccttttcaccgccagacataatctggaggaacgggcccttgcatttatcaaacgttctgaagaggcagtctcccggattggaaccatcggagccaggcatatcagggatggtgatgtggtcatgacccattgcaactccgaagctgcgcttgcctgcattctcaaggcccaccagcagggaatggatatcgaagtctatgcaacggaggtccgaccacgcaaccaggggcatatcaccgctaaaaccttatctgatgcaggcataaaaacgaacttcatcgttgattctgcagccagatatttcatgaaagaggtggacatctgtattaccggggcagatgcaatcaccgtcaatggttcaatcataaacaagatagggacatcacagatagctcttgccgcccatgaagcacgggtgagttttgtggttgcagcagagacatacaaattcgccccctgtacgattcttggagagcgaattctcatagaagagcgttcaccagatgagatactctccggtgatatgagaaaacaactaccgcatgtcaccgtgagaaatcctacctttgacattacaccagccgattatgttgacctcattatcactgaggccggtgtttatcccccggagatggcatataccgttattaaagaacaactccactgggataccgaggatatgagtttagagcttccctattgcgaggaagaataacatgacagacgttattgcaacatattatttcagaccacgagaaggagtcactcctgaatgggctgcacaggctatcgcagaagaacagacgaccggaacctggaccgacatctccacacggcaaaactatgtccactacctggatggcgttgtggacgaaattcatcccagtggtggcgggtacacctgcacaattcggtacccgtcagagatatttgaacctggaaatatcccccagtacctctcggttcttgcaggcaacctttttggtctctcccggatagcagcagtgcgactggtggatgtggagttttcgcgtgacattgtcccctttaaaggaccgaaattcgggatagaaggggtcagaaaactggcaggcactgttgaccggcctcacgtgggaacaatcataaaacctaaggttggtctgaacccgaaagatacggccgcagtcgcatatgaggctgcgattggtggcgtggatctgatcaaggatgatgaaaccctcaccgatcaggcattctgtcctcttggagaacggcttcctctcattatggaacaacttgaccgggtgaagagtgagactggacggaatgttctctatgcagtaaacatctcttctgcaggtgacaaaatcgtccagcgggcacgagaagcggcgaggatgggtgcaaacatgctcatgattgatgtcatcgtgtgtggtttcgatgcagtcagggcagtcgcagaagagcctggaatcaatctgcccatacatgttcaccggaccatgcatgcggcaattacaagaaatccggaacacgggattgctatgcgccccatatgccggcttgtgcggatgcttggcggggaccagctccataccgggacagtttcaggaaagatggagcacgatgtcacggagttgcgcggtgataacctggccctgactgaaccattctttgatctgaaaccgacattccccgttgcttcaggcggactccatccgggaggggtccataaagaggtcagcatgctcggacgggacatcattctccaggcaggcggaggaattcacggccatccggacgggacacgggtaggtgcaacagcaatgagacaggcagttgacgccgccgttgccgggatttcaccagcgacatatgcagaggaccatcccgagctgaaacgggcactggataaatggggaattgcataactaatatacatggaaataccatttgtcaaactccacggaaacgggaatgactttatcctgatcgacgagtacgcaggtgaaaaaatacctgatgacatgaaaggtcattttgctgcagtctattgtgacagaaagttcgggattggtggggatggtgttctgtttctcctgaaatcgaacgatggtatcaggatgcgcctcttccagcctgatgagagtgaggcagagatgtgcgggaatggcatcaggtgcctggccaaatacgcctttgatgccggatatgtgaaaagcccctgtactatccagactcttgccggaccggtcatggttaggatggagtatgatgaggacggcgactttatggcagaagtggagatgacaccgcccatatatgaaagtccggggataccggccaaagggaaaggtgattttcatgagataatcaacgggtacgaagtatttgccgtcaataccggtgtccctcatgcagtcatctttgtcagggatctcgactcccttgatctcataaaaatggcccctccaatcaggcacagccaattcttcccatccggagcaaacgtgaattttgtggagataaccggagaaaattcgattcagatccggacctttgaacggggcgtcgaagcggagacactctcctgtgggaccggtgccacggcctcagctgcaatcgcgtaccgcctctctaaaaccggtcctgttgtcgaggtggagactatcggcgggcctctaactatcaccataaaagatggagccttcatgaaaggtcccgcagatacggtatttaccgggatgcttcatcttgacgggtaatttcccctctgttttttccgcaataccctgcgatttttcctgcggagagtgccagaagtaaaaatccgcatacagcaccgatcataagcagtaccgttgtcaggggtgatgagccaaatgagctctcaccaccacgaataagaagaaggacgccttcaggtatcgctttcgcaaaggaactgtgaagaagagcaggatcatacactgcggttctgcttacccatccggagaggtgcaaacttgtgccaagcataatccccccggtcatgagcagggcggttgttccacttaaaatatccattatcccgccttcagaggttaccagttcctgaaacaggtatcctgcctggtgacccaggaagaggagaagaaaaaactctgcgggcagaaagagagaggatgccgccggccagacagacacccagaatgtctctgtggcaatcagggccagtatgcatgagagtaaaaacctccggcggttacccctcataccatatatgccagtaatgaaaagaagtgtcagaaatagtagaataactggtcgtgctgatgggtcagagggcaggacaggcacaatgatcaccatcggaatgagtgcaaggaataatatcggcagatcattccagacttttctgctacccttcaatacatatccatacgtatccggattttgccggatgatatccataacaatattttttcctctccgaagatgaactacacggaagaattgatgaatatctttaatgcactctgcgggcaatcatgtgataccggaatcaggatgatctatggtcgatactatcagtgacaaggaggcagaacgctggaagtctgaaggtatccgttatgccacaaatcagaaatttgaagacgcaattcactattttgagaaggcatccgcactaaatccggttgatgaggagatatatttccagaaaggccttgcgtttatgaacctcatccggtaccaggaagcagttgaggcctttgaggaagccctcaaattaaacgataaagatccccggtactggctctatatgggaataaactacttttttatgggccggtatagtaaggctattccctgttttaacatggtccttgagatagatccgaccaatcttcatgcattaagcaacaaaggttccgctcttgcggagatcgacaggcaccaggaatctgtcgagtgttttaaccggatcctcgaacttataccaggggatgtcaatgcactttttaataaagggatcagcctgatgaaactgaaagactataaatctgcaatcggatgctttaaagagatattaaagcaggatgcagaggactccgatgcatggtttgaacttggaaactgtctttcaaagactgacaactgcaaagaggctatcaagtgttttgaccgggttatcaggattgagcctaaccatgcggaagtgtatgatgcaaaggtggaatgcctccgaagtcttggcctgaatgatgaggcagatgaactcattgcaaaacgtgagatggacgactggtaggtccatcgatcacccgataatctaaatctttatttctcccgttctcctatgcaataggttggatgagttgtacaataatcgtgggcgggaactttggtgatgaagggaaaggaaagattgtttctcatgttgctcaccaggatcgcccgacaataatcacacggggaggtgttggtccgaatgcgggacatactgttatggtcggcgagaaaaaattcggcgtccgcatgtgtccgtccggatttgtctatcctgatgccagactgatgatcggaaccggtgtgctggtagatccgcgtgtattcaaacatgaaattgaggttctcggagtggagggaaggatattcctggataagcggtgtgcaatcattgaagaagcacatattcaggaggataaaaccaacacgcacctgtcgaaaaaggtcggatcaaccggcaccggatgtggccctgcaaaccgcgatcgtgccatgcgggttgccagactcgcgcgtgatattcctgagttgagttcatatcttgtcgatgtcccacttgaggtgaataccgcgcttgacaatgatgaaaatgttgtgattgaagggacacaggggtttggaatttctctctacttcggccattatccgttcgttaccagcaaagacacctgtgctgcacagatggcggcagataatggtgtcgggccgaccagagtggatgacgtcattgttgtgtttaaggctttcccgaccagagtaggagaaggtcccttctcaactgagatgtccagtgaaaaggcacatgaaaagggcattcaggagtttggaacggttaccggcagagaacggcggattggaacctgggacggagagatggccagatatgctgctatgataaatggatgcacccaggcagctatcaccggaattgaccacgtggatccctcctgttttggtgctacccagtactcacagctgacaaagactgcgaaggatttcctgaaacaggccgaagatgacatcggtgcaccggtaacactcatctcaaccggacctgaactctcccagattattgatatacgggccgaatacgaatgaaacgcgaattatacgatatactctgctgtccggtctgcaagggcgaccttgaactgaaagtgacagaagagaatgacattgagatcatcaccgggtcactcatctgccacgcctgttcagttacatatccgatagaagacgggattccaaaccttcttccccagaacatctaatacagatgataatccaactacctgtccttttttttgcactcctgatcgaccgggtgtgcggtgatcccaagaccaccctccatccggtggccctgatcggccaggtaattggctggtggggaagaccggaacaatatccgaagccatttcaccggtttattggtgttatcgggtggcttgggactgtaattctcttcactatgccttttgctctcttccagatggctgcaccatggtatgtatacctgatagccggcccgtttctcctcaaaatctgctttgcctggagagcacttgaagagcatgccagggcggttgcacaggcagcatccaagcaggaacgggcacaccaggcctctcttttggtatccagggatacgtcagtactgaccgaggagcagatcctctctgccgcctatgagtcagttgcagaaaatctcaatgacagcatcatcgctcccctcttctggtttctcatccttggcctgccaggtgctgcgatgtaccgggcgatcaataccatggatgccatgctggggtatactgatgagcgaaaagacctgggatggtgtgcagccagaatggatgatatcttctccttcattcctgcacgaatatgcggccttctgcttttcatcatgtatgctatgaagggaagaatcaaaccagcttacgcaatcttcattcgtgaccggaaaaagagaccaggatttaacggaggcatccctatgtccctgatagccggaggggaggggatactctttgaaaaacccgggatgtaccggataggagaggagattaagacccttcgggaggctggtccctcgataatccggacggttcgtctttcaaccctccttttttgtttgtttaccggtatcgcactagtattattggacggtgtgcccaacatatacggaatatgatacttgaagacctccggttcggcaccgaacttattaaacggggatttgcgtccatgcaaaaagggggcgtaataatggatgtggtatctgccgaacaggccggtattgcagaagacgcaggagcagttgcggttatggcacttgagcgtgttcctgccgatatcagagcagcgggcggtgttgcccggatggcagacccaaaaaagataatcgagatcatggacgcggtctccatcccggtcatggcaaaagctcggattggtcatttcgttgaagcacaggtgcttgaggcactgggtgttgacatgatcgacgaatcagaggtcctgacccctgctgacgaagaataccatatcgataagacaaaattcaccgtcccctttgtctgtggtgcacgaaatcttggtgaggcactgcgcaggataaacgaaggagcagccatgatccgtaccaagggagaagcaggtacaggaaatgttgtggaagcggtgcggcataaccggaccatcctctcagagatcagaaaactcaaagggatggaagagattgaactcgtgaaacgggcacgggaacttgaagcccctgttgatcttttaattgaaaccgcaaagcgtcagcgtattccggttgttaacttctctgcaggaggcatagcaacacccgcagacgcagcactcatgatgcagcttggaagtgacggagtatttgtcggttcaggaatcttcaaatctgaacagcctgaactcatggcaaaagctatcgttgaggcagtaaaccactacaatgaacctgctgtgatagctgaggtctccaaagggctgggcaatgcaatgcgtggtcttgacatccatgccctcccacctgaagaggtgctctcaaatcgtggctggtaatgctgcggttggtgtcctggcactccagggagatgtttccgaacacatctcggcatttgagtcggcaatacagaacctgggactgaacatcccggttgttcccgttcgaaaagcggagcagattttggatctgatggcgcttgcaataccaggtggtgaatccacaaccatcatgcggctcatagaaaagaacggaatgagaaacatcattcagaattttaagggaggtatctttgcaacctgtgctggcatggttgtgtctgcacgggaccttatcaacgaaaccaggtttacccctcttgacctcctcgatatcaccgtcaacagaaatgcattcggaaggcagcgcgaatcttttgaagcggaccttcagatatcaggatttgataccccgtttcatgcaatattcatcagggcaccggtgatcaccagagcagggccggatgttaccatccttgcagagattccacaggggatcgtggcggcaaaaaaagggaagaaactcatcctctcctttcacccggagatcagccatgacctccggatgcatgagtacttcctgaaagatatgctcggctaaaaagaattacttcgcttttccctgatttttcaccgcttccatggcggcctttaccttctcctcatcgccaagataataggatctgaccggtttgaggttgtcatccagttcatacaccaatggtataccggtcgggatattcagatcagggatgtcagtatctgatatattgtcaagatgtttgaccagggcccgcaggctgttcccgtgagccgttatcaaaacccgctttcctgatctgataaccggagcgatctcgtcattccagtacgggatgaaccgtgctaccgtatccttcagacactcggtcatcggcagatcgcttctctttatctcctggtaccggcggtgataggatggattatcgaggttatccggagtataggccggtggagggatgtcatagcttcttctccagatatgaacctgctgttcaccatacttctccaccgtctcgatcttattcagcccggtcagagccccataatgacgctcattcaggcgccatgtccggatcaccggaatccacataaggtccatctcttcctgaataagccagagtgtccggatggcacgtttcagaactgacgtatacgcaaggtcaaactcaaaaccctgctccctgagcgctttgcctgcagcccgtgcctcatcaatgccctggggggagagatcaatatcacgccagccggtaaaccggttctcccggttccagagactttctccatgacgaatcagaaccagtgtatacataataaatcatctgtacgttggtgatacaatcggttaattcatctggaaaggttttatgggaacgctctccaatcatcagttatgaccattcgtaccggatggctactgatgatactgttccttgccgttatgctcccggcccatgctgcagtgaatattacatcagagggattgatcgtgagtgaaaccggatatgcgggtggttcgcttacggtgattgaagtggtaaaaaatgcaggagatgatgagactgggccggtgaccatctcctattatctggtaaatgaaagtgaggggaatgcaaagcgggttccgattggatccgcagatcttgagtcgataacttcaggaggggattattcaagcgtaaagactttccttttgccccttgaccttgccgatggtgcatataactttgtcagggaggtcatgggaaaagataccacacaagttcagcaaaaaacgatacatatcgcggatccactccccgatggcagtgatgcagacctggtgggatccggcctcatcatcccctctcgtgccggacccggggatcagattcgggttattgccgcggtggaaaacagaggaggaactgatgctggtatgttctatgttgatatgtacctgacgaaccggtcggttcaggcaactgagccactgcttctcggcacgtgggaggtgggatcagtaccggcaaccggacaggcgagcaccacccggacttttaccatcccccgtgatattgtagcaggaacgtacggcgtactcatggatgtggatccgggcaatcttgttccggagcgtgatgaagcgaacaatgactggtaccgtgacgggatgatccggatcatcgccggagggccgcagaccatcgctcctcctgttcttatgaacaccactacatctattgtcatgatcagtcaggaccagaactcttctgaccagtcctgatatcatccttttttcaacatcctctctatgcaccagcgtatattttatactgaaccaggtgatacattatagtggtaaattgagtcagcagtggataccttccgtcagcaatttattcttcgctccttttttcttcgtgtttagatagggggccggctctttccggtccccggtattgatattcactgacagtttaccggaggttcgataaacatgttctcagtatttggtattacagaccctgctatctggatggggtacgcaatcgcgataggcctggccatagcctgtgttatctacggagctctgaactggaacaaaggaggacgcgatcatggcagttgacccggcggttacgatcatccttgttctggtgtatgttgcaatcaccttggtgcttggataccttggatacaaaaaaaccattcatgcagaagattatctgctggccggacgggacagtcatccggtgatcatcgccctctcatatggtgcgacgttcatctcaacatcagcaatcgtggggtttggcggggttgcagcaaaccttggtatgggacttatctggctgacggtttttaatataggggtagggattcttctggcattcgtgctctttggaaagaagacacgggagaagggagcagaaaccggggcgattacattccctgaccttatgggcaagatcttcaataccccaaaactccagttcatcagtggtattatcatcctgctggggatgccgctgtataccgctgcggttctgataggaggtgcacggtttcttgagacgaccttaagcatctcctacaccaccgccctgattggatttgcagtcatcgttgctctctatgtcatctatggcgggcttattgcagttatgtacaccgatgcgttccagggagcgatcatgctcattgggatgacaattcttctggtgctgacctacatatatgtcggtggcgtgactgcaggccataaggcactcgctgccatgtctgacctggttcccgagacacttgccgggcagggaatgacggggtgggcatcaatgcctgaactaggctcacccatctggttcaccctgataacaacgcttgtccttggtgttggtatcggtgtcctggcccagccccagctcgtcgtcaggttcatgaccgcacgggagaacagggcattaaaccgggcagtactggtcgggggtccattcatcctgatgatgaccggagtggcatttacggttggtgcattgacaaatgtctatttttaccagcacatgggaaagattgccattgatgcagcaggggggaacgtagactcggtcattcccctgtatatcaataccgccatgccagacctgtttgtgataatctttatgctgaccctgctttcagcggcaatgtccaccctatcgtcactctatcacaccatggggaccgctcttgtctgtgacctctggggcagaggacagaaatgtgccatgtcacttcgggcaaaccagattggatgtattgtgatgatgatcctgagtgttgttctggctcttgccatgccggcgagcattattgcccgggcaactgcgatgttcatgggcctgtgtgcctcggcatttctcccggcatttgcagtaggggtgtattccaaacgaccttcacgggcgggggcgatggccagtatgatatcaggagcgttcatctggttcttttacacggtttttatccataccgccgaagcaaaggcccttgggatctcccagttcctgaccggatcagtaacgatactgggtgcaccctggaccgttatcgatcccctggttattgcactcccaatatcactcatcgtcatggtttcatttcaggttcgtgaacgtagcgtgggagtgaaaagccaggtataaggagggcaataattccggttttaaataaaaccaaaatttttttcccttccagaaaacgatgatattcagagagaaagaatgctcattttacaaatcaggaaaaagatttcatcttcgaaaaataatactccgtcaccggtactcaggaggttataagatgaacttcagaccagggctttccctgcttattatcctgtcatttcttatgattcccgtgtttggggaagaccttacgaaaatatacgggagcatcccaaagaacggaataaaccaggtcactcttgacaactcagcaaatgataaggaagcagttgttgtgtttaaagagatgaactggccgataccatttgcagtatacctggctcctcaccagaccggagtattgaaactgccctctgagtcataccaggtgtattatacactcggtcgaggctggaatgttgctgaaaagcggttccatagcgaaccggaatactacatgatgacgggtgtatttaaccccgccgaaactggtctcatccatgaagaaaaacttcgcccggcaagggttgttgatgatacctgggatcctgatgcatatgtcccaagcacatatggagagaagatagattatgctgaatggaaatgggctgagagcaccatcccgctctatcaaaatacaggttctcccgatacacgggtacctgtcgatgagagtgatttccctctttcctaatttttttatatgtattcccccttccctgacgaatacgtgctgaagattatgcagatacctttctcgtcatagctgaaaatggggtactaaaaagagacgaggctcatcatctgggtgaaatggctcggtttagaaatcgtctggtccaccagtactggagaatagatattgcggattatgctaaaaaaatcctcgaccttttaaaaccctaaagataattaatttctttttcagataattatccgaaccaagaaggaaaaaaattagatataggggttgcggagacccttgttaacaccgaatgttgcacggtgttcgagctccttctggttcttggtgatcttttcggttgcaagcttagtgacgagttcaagacctggcttgacgctctcaatcggcttggtctcaaagataccagcggcgactgccttgttccagatattttctccattgttgttccggataaacacagtggaccatccgtcaggagatccgactgaaccggtggagatatcagcaaggtttgccacgtagtcaagacagacatggcagcctggctgttcgtacttgtgagtgagtttgagcgggatctgggagactgcaccacggttggtgtatgcccagtatttccccttcccgatatcggtcttcttgagtgagtgcagatcaacattgcagtggtcctgcacgatctgagtcatgctctggtatgagaagttctccatacagaaaatacccattgcaagagcaatcttgtcacatacatcacgaagtccgaccgggtagagttgtgcttttcgaagtgcctggatctgacagggagttccgacaataccgaccttgtcaagaccatacttgcgtacagactctttcaggacagacatgtttggacagacattgtatctggttccccgtgaagacaggatctcctctggagtggttgccacaatcggctttggctgccatggcttctctccctggcctgcaacgattgcaccatcaatgataccctcttcaagagcgtagaggaacattgaggtgacaatcccgccatcctgggagcagcgcagaacttctgcactggtgctgcgggcagcgactgcggatttatatttgccaagataatccatgattagttccctcccgggttcatggcaccatcaataataccaaggatgttttcgtactggttcacaacatcaaagctgaagaatgcacgtgggcaggctgcatagcaggctccacacttgatacacatatcacgctggatgttaggcttgccttcttccatggtgatggcgaagaccggacaggacgtggcacaggtaccacagcccatacacagaccctggttaataaccttggtcatgatgtcacagccacatgcctcacttgaagttgccttgcttccctcactggcaagtgccatgagcggtgcaaggtatgcttttgcaagtgcctgctgctcgggagttcccttcaggagcaggtatgccatgacacagacatttctgatctgctgcgggcatggagcacagccggggatatacacatccacatcgatgacatcaccgattgggacaaatccctcatgctgtggctggttccactgtccaccacggcagaaccgggtgatatttccatatgcagcacagccaccgagagcaacaacaactgctgctttctcacgggtttctttaatctcttctactgacagttcatcctgcagacagactgacccctcaaccagtgcaacatccatctttggaatgtgacgtgcatcggcaagagttaaacaatatacgaggtcagcgtaattgtcaaggatggtgaataacccctcgtagttgtcggcgagggagacaagacatcctgtacacccactcatgtgtacatgtccgactgttattttgttagccacaggcctttcctccttctttggttcttctttcgcaatcggtttagatactggagccgtaggttcctgcgatttcggagcaggtcccttcttctcctttttcccgaagatcaatgatagtagtcccatgatttaccccaatcattttcagcacgagctgtactgtccttgggatcgcttctgttacctcttcggagagtcctatctcaaattctggttcagaaacccgcttcggctgacacccgatgatatcaatcttcacccggtttttcagctggtgaatgggttcggttaaatcccaggaatgagcatcccggtattttcccggtggcagatcatcagggctgatgattgcaatctctccaggttttcctccgaaatcagcaatatctatgatgaaaaggtgtttgaccggttcatccgattgcgcaagaagggtaaagaggaaatgcggaccaccaaggccggcatctattacctttacattctcgggcaggtcgagtttctggagttcctcgactacggccggtccaaacccatcatccgcaaagagcgggtttccgcacccgcagattacgatctcctggaacagcatgcgcagggcactctcactggacaagcttctgggcgacaatcttcttgctctcgtcaactaccagcatgtgggtagcgcaggacacacaggggtcatatgcacgcatgatgacctcggcaagctgccatggtgctccctcgagagcccgactgcaggtcgggaagttccatgtggtcggaacaagaagggtgtactcctgaacttttccatccttgacgcgggcaaggtgaacatcacaaccacgtggtgcttcgttggcgttccatccaaggctgccgtcaccctgtgggatctcgtctgcaagtactgaaccattgcagtcaagtgcatcacaggcttcgatcatggtgtacagacagtccgggtactccatctgccgtgcaatctgcagacccattgcacccttgcggtcataattcttgaactggaccagacgggcacggggaccgacttcgaccggctgaccgtcatagagcgggactgaagtacaggcctgcatctgtggccaggtcttggttccgaccttggtggttccaccgaccgggtagtctgcatcttcaaggcttacttcgagttctccctggtaccagttatatggtgagacatcggtccaccggtctggatcccacttcggttcaaagtcaagacttgaactgtcgaagacagggtctactgccatgtaaccctggtcatgccatccgaacttctccggaatctcgacttcggtctttccgacagtaacggtgccacggttctcccagtttttgaagactgcaatcatgaagtccatctgggcgatggcaaggggaagggcctccttggcaagatcatagatcttctgttttgcctgtggggagatgttgtaatacataccaccgacccgggggtttcctgggtgaatggcttctccaccgacaatctcacctactgtctgcccgatctcacgaagccgctggatccgctttgcaacggttctgactggctcttccggagtgaacgggttgatcttggtgtctgttcctggaatgtacatatccggcagactcagaatattgtgaagtgcatggctgtgcagcctgtttgcacactgaaggattgttctgagcagatatgcatcctgtgggatttcacaaccgatcgatgcttccatagcgccgacgcctgcgagagtgtgggcgattggacagataccacaaacacgggatgagatcttgggtgcctggtgcatggtcttccctacacacagtttctcaatacctcttaccggagtgatactcagccaatctccacgctcaattattcccgcatcgttgactttaaggacaagcttggagtgtccttcatgtcgtgtggttggggaaacttctactactttggacaagagaatcgcctttgatatttgtttgttcgcaatgctgtacaactcatatcaagagccctcaggagatctgagggtatgaccgtaccattgtacgacaaatggcatttggctataagatatatctaatttgccatttgaaaggaaatcatgtcacgattgtgggctgatatccagaaaggattaatacgaacatacattttttcacaatcagtatgatacagagctgcctgagttcgttctccaccccagcaattagactataaatatcttataatttagagggttttagagcaaataaagactttattgaatccaaatacaggcactcattctctttgaaaaaaaacatttttgtgttactcaatcaatcggtaaattttccgagtgccttttgtaatggtttcggttttttaaaaaaagactgaaattagtcgcttttaaacaaaactgatgaagaatactgcttcgcgctcatacatacccctgattaaacctatagcaatcgatatattccggaaaaaagacacgtacatgagtcattggacatgcctcacggaacctgtctttttcgatccactgcctgccagtccatactctgtgacatcaggcactaccaggaagatgccgaaagtatcttcagaaggaaggagcggtttgaccaggacaggagggatttttatgcacgtaccatggtcctttttgctttgacaaaccgtcttatggatctggcacgtgaagtcagccttatccggggatatatcagctccgaagagcaggtgaaaaacaaggttttctttaaacgactccatgatcacggggtgatctcatgggagatgcgtcagcagatgatagaccttgtcaatttccgtaatcaggtctcgcatcacttttatgaagtaacaagagatgacattgaaaaagtctggcagacgatgccagtctgttctgagttcgtcagcatcatggagcaggagctagcctctcatgatcgtgtaaaaaagggcatggtaattattgccggaactgcacttatcctgctggttctcgtgctcctctggtattttagctgacatcaagattttcaccattgatctcatccgcaagctcggcaatagttgcctgccgttctgcaaacgcatcatgctggtgaatactctcttcattatcctgtgcaatggtaaccacggaatcaccgggaagatcgccaaactctgcatggacccggcgtgccatctctctgacacagtcctcgacaaaccgcgggttcttatgagccgaaagaaccacatgaccctcatcaccacgctttaagagttcaaatatcggcgtagacatagactgcttgagaatcataatgatcttctctagttttacatgactctcatcatcggtctcgatagagaggaaccctctcccccgctgattatgcgtagccatgggaacttctttgaagaatgattctatcttatccttagcaatatccaggttttccataacctcccgtgcccgttcctgcataatattctgggcacacggacacgcagtcatacccgtaacctcagcaccgatgctcttcctgacgatagggtctttaaatgtcctctgtgcaatcgcactggcaaacaccttgactacctcctggcagagtgttccggtgaccggagtttctccggcgaccatgaactcagaccgcatctgcacttcggtccggtctgcatactcatgcttatctaaaagccgccgtgcaacacgggagcagagctgctcaatctcttttacttctccttctatcgcagattgtaaaacctcgtcgataacctcaaaatttctggaaaggtttgctcctttgagacttccggggagatctacaaagatatcaaagttggagatgaagataaccggacgtttccctggtctggtaacttcgaccagtttttttacattctttacacctaccctggtcaggttaatcctgacatcaggaagagtggactgcacatcaggcagttcacgggaaaaacccctttcagatgtttttagcagagacattgcgccctcggagaaaaatattgagtggttcccataagtgggatccgaattatactaaaacttttcagttgggattctgattttctcgtacgctatacccacagccgcaggtgcaccataccatctcatccataaaaacaagggatatttaattgcggttgtgaaagaaattatgaatgcatggtcgaatcatacgagacccttctgaataaggcatacgaggaggtgacagaaccgtcagaggatggagaacgctggtcataccctgaacccaaatcaataattgaggggaaaaccaccatccttgagaacttctcagacattgtcagtgctcttcggcgcgattctgatcacctgatgaaatacctgcttggggaacttggtacagcaggaaagatcgacgggtcacgtgcaattttcaatggaaaatttgaagattcactcttctccccgatgatccgcagctatgtcgatgattatgtcatatgttccgaatgtgggaaacctgataccaggctctataaagatgaccgtattctcatgctcaaatgtgaggcatgtggaagtcaccgcccggtcaggaagaggaagtccaaggttgaatccggatcctccggtcttgaacagggcaatatcatcgaggtcaacatcgaatccacgtcccggcgtggggacggagtggctaaagtcgggaaatatatcgtgtacgttgccgggggtcgtccgggccagaaggtaaaagtaagaatagcaaagatatcagggtctattatctttacagaaaaaccctgaatctacttttttgctgattgttcaagcgaggataaaagttcctcgcactggccggacaggcgcctgcatgcatccaggactggttttaccgggtcggccttattgtgagtagtaacggtcaggaccgggtctgaaaactgaaattcaatgacataatttgcaacatcaaccgtaggatcagtaagaatctcggtctttaatgcgttcatgaatgtatgtccctggccggcaagagaaatcctgaccttatcctcaccgagttcgagaaccgtaatattcatttgtactttgttagagttcagatcagataaaggtagagcgcataaacagattaaagggtgaatacctctccgtcatgaccctgtccaggtgcatcaaacggaatgatatgactcatatgcacaatacggaaatccttcaccttcagttctttcgcaagccgtattgcctcttcgtagttcagatgcttttcaaccttcttatatgagtcggtaaagagaccgtcaatgaagagcatatccacgccccgtagcagatccctggactttggcgggataagttcattggtatcggacgtatagccgattctggtcctgccatctgatattatgacccctgtggtgtagatattcgggtgctcaaccctgaccagcgtaacctcaagcccgcaggtgataaaaggtgtgtacacctcaaccggccgctcttccctgataagaaagtgaaagacagggctgcatgacgcaaggacctcaggagcaccatataccggggggatacgttggacccggtaaaaatcaccaaaacccatgaaatgatcataatgcccatgggtccagatgaccgcatcaatcttcggtgatccggcctgtaagagctgccgcctcaagtcaggtgttgtatcgatgatgaggtgacggtcttcattcgttatcagaagagatgtccgaagccgctcgattcctgcctctcgtgcataggtacagtttttacaatgacacccgacatgcggtgtccctacggcatccccggagcccaggattcggatttccatcagatccagttcctggctttatgctcatctctggtttttatcaggagttcccccttgatgatgtcatcacgggtgagctctgtacggccgtcggtaagcgcagagaggatcgcctcacggaccagcatcttcaggtctgcacctgaaaacccttcggtctgctctgcaacctgtgcgatgtcaacatgggtttctgattcagtaagcaggcggcgaaggattaactcacgggtcggaaggtctggcagatcaaaggggatgacttcatcaaaccgccgccatgctgcctcatcaagaagctgggggtgattggttgcaccgataaggaggactctgtttctaatcaggctgatcctatcaatattcttcaggagcgcattcaccgcccgcttcatagccccgtggtcatccccgacccgactcttggcaaggaaatcaaattcgtcgatgaagagaatacagggagataacaagcgcgccacatcaaagatccggtcaatattctttgatgtctctcccagatactgggatgtaaccatagagagccggacttcaagaatcggcatatgaagcactcgtgtcagggcaaaggctagtgaggtcttcccagtacccggtggtccgataaagagcagttttccaatctcatagacccgccggcttttcaggaactcaaggtgttcaagcgcaacctttagtttgacaatccggctgagctgatcaacagagcagatgatgtcgtcaatcgtctgctccacctcctccggtgcactgataatgataagatcaagacctgatctgagcttgtcatcctcggcaagcatccgggagatccgccgatccagatagatcctgctgtcctcaaaccgggggtttctgtccctgacctcttcatatgtgatactgaatgagggatcctgctcccgggcaaaccaggcaagggcagggtttttctctatccgggcccgcccgccattcttcaaaaaccaggtcagaccggcaggaagtgaggttatccgaagccggtgtccgaactcttcgtataacgtgagaggatgcttatccagcctgaggtgcgcatcaggaataccaagcactcgctgcagggcactctcggcaacgacaaccggagtgcgttcaccgtccatagaatggatcccatagacttcacgggcaaccggagtcagatcgttgacgctcaggttagaatactgattataaacctcagcagtcaggagcagttctatcaggtccaggatctcctcatcacgggtcatttcgataatccttatactacgttttcatcacagaagaatcgctatcatgcagtggtaacgatacaagcatcgccggttacgatcatggtgtgttcagcctgcgacacataagagccgggaacatcagacagaaccggatatgatctgatgatgccatcatgtatcagacgggagagggcaagatctgctgatttcacatgaacatgccttctggcaaatggcatcccattccggctctcaatttcctgtaagatcttgcgggcagcagggagcctgaccggacgacgtatctgctgggaaaagatctcttctctcctgccatcatgcacaaaaccggtaccggtggatgcaaagggttcgattgcaaggaccattccttcttcaagtaccgcaccaccagatcccggaatattgggaacattcgggcctttatgcaggcagtattgatctaatccatgaccggtaaggtttgcaaccggcaaaaatccgcggctcttaatctcatgtgcaactatggtaccaagggttccgatcgcaacacctggccgtaccgctgcgatggcagcatcacgcgcagcaattgaggcctcacacaggagcggctgatccccgagatctaccgtacaggccgtgtcagcgatatatccatcaagatggacaccgagatccagttttaccatatccccctttgcaaaggtccgggtatcatcaggcgaaggagtgtcatgagctgccgcctcattgagggagatgtttaccggaaaggcaataccaaaaccctcatccagaatggagttctcaacaaattctgctacttcaaggagcgaggcaccaacccgtatccgctctgctccttcacacaggattttctttgcagctgctcctgcctgcatataccggtcaaatatctcttctttcacaagaccatctccagaggataattcgtaattcttgaaaaaccggtcttttccacaactcccaggttttctatccggacaccacccgtgtcacggtaatagagaccaggttcaagcgtgatgacatgccctgcccgcaaatctccaccagtcccggaaagggacggctgctcatggatctccaggccgacaccatgaccaagactgtgaatgaatccttcggtatcagactgatatccaagttctgcaaaaaagtcacgcactgcctggtaacatgctgctccactcgccccttcctgtaccatattctcactcatgagcagggcatcccgaaccgtttcatagagttcagtcacctttccggacggttctcctctgctgactgtccgggtcatatctgcgtggtacccagttttgttatcacagggaaagacatcgatcacaatcggttcatgtgctttgagtactccgcttcctgtgcaatggggcatcgccgtctccaggccacatgccacaatggtatcctgtgcggtgcagtcataggcaagcataatcttgttcatttcatacctgaccaggtcagatgtgagtggagcatcctcataccagagcattcctgacttgacatctgcatgccgtatcatgctgactgctctatccatcgcagcctctgcagcccgttgtgcattggtgatccatccaatctcttcaggagtctttatggcgcgatgagcggaaagtcctgatgaggaatctacaatgaccgtattatagggctcaagagcacgggtaagggcggttggaaaatccggagggacaaggtacggaccctcggaaagacggcggatcatctctgcctggatcttccagggatctttctcatactcaaaaatctcaagataccctgcctgttgtcgggtaaggatttctgcaggagattctctctgggcccggtcggcttccatgagaggaacaatcataagagggggattatcaggtctttttagtattgtgaccggatcatgggttacaaaccgggtcatgtgccgcattgctgcattctccgatgatgcatacagacaatatacggctgcgccggcattccggatcaggtcatccaggctgtccatctcatacaggttttgagtcagaccacaagtacttttacgcgaaacgtgatgtatttataatggatgatgcttcgaaagagcagttcagatggcgattctggcaccttaccgtcatactgaacggagtgatcctgttttttgcactggtaccgattgcattgtttctctttccagaggcatacaaagtccctggagcagtgatcagccttatactggcagtaattctcactgtaatcttcacacgcaattatcacaaaacaaaagcctggctgagtgagcatgcataaaaggggcagaagaaccgatgcttgagaagatccaggaagatatcagccttgcatcacgtcatatcgaggttctcagggctgttgcagatcatcagcccatcggaatcatcaaattatccgaacttctaaacgtccctcagcaccggatccggtattccctcagagttcttgagagcagcgggtacattcgcgcctcaagtgccggagctatagtgaccccaaaagcagaagagatgttcatgcatctgaatgaagatattgacgagataatccggattgtcagcatgatgaagcagccctgatcacctttgtccggccacctcaacatttattaataattacatcacacgtattagagcacatctgagccgccataactcagttggtagagtgactggctgttaaccagtttgtcacaggttcgagtcctgttggcggcgtctcattttttgggcctgtagcttagcggtgagagcgcccggctcataaccgggcggtcatgcgttcgaatcgcatcaggcccatgacctgtattttttaagtagagatgattatgttacttcaatgaagtgttcctgttgtggtgagaaccatatcatctgtcctggagatatcacttcacgcccctcacaattttttgcaccctgtccccagtgtaatccgacgccacggccaaaagacaaaccagtctcttctggggaggatattccaggaccctgtcagtgtaaccgccggtttatcgatgatgtgatggcagatatctaccagatcctgcagaaagaaggaatattccatggcagtgaacccctctcatccattggaacccctcttatctcccccggcctcttcctccgccgtcccccggtactccctccccggtctcttctgattatctctgatctcataccagtaccagtggctgaaatcgcataccggaacgtgcccgagctgctgggtatcgtctatcatgcccatgagatacccggtcccggtgatgtgacctatggacaggaaccaacaatccatgaagggatcctggtgtgtggatgtgacgtcagggcagatatctttctttccggaaaaggtcccgtggttgtgatcaaaaaacaggctgagatgcatattgaatttccgaaaggtatcgacccaaagatcttcagtgttgaggagcaggtcagacgactgcatccggatgtcttcattgatgcctgcgcaggaccaggaacactcggccttaccgcagcactctttggtgtgccgaatatcgtgatgtgtgatgtctggcatgcatcagtctggagtgcaatccagacgatcagagtaaaccagaaaaaactcggaattacaacgataaccctctacgatgatgtgaagaagagaccgccagtctggacaggagaacctgccctcatctgttctgccaccggaaacggaatcaatatccagctctaccatgggacatacgaactcctgggagcggatctgccttctggaaaacggctgaccgcattcgatccctttgataaagagtctttcaggagaaatgatctatttctgacagcatggaaagaaaagataggaggggaagtttttattccgtagctgcagcataattatggggactagcccgggtggatcggcgtcacttgtgacctgaaatcgtcggaatgcagggggcgaagtttgaggaaggttggtacatacggcctgtatctgtcgtgtttccgacgtagaaaccctgtcctgtgaggtcggtggccaggtatcacaccttcggaggaaggaacgacctgttgtcgcggggaccggttcaggcccggaagggagcagacttaccgtgaacattcggcgcccatggggttgcggggcggagaaggagacccttggaaaaggctgcaatgaccgatcgaccgataacgtgtccctattattctgatttattctgattcttatggcaaaagttgcgattgtcggagcaaccggaaaggtaggccagtatgcagcactctcgatatcccgtattccgtatgtcaacgaggtccagctgtatggaagaccgggttcggaatcggtgcttgacggagtggccagggatctcatcgattcatttgctgcaaccggaacagacagtcatgtcagctggagctgcaatattgaggatctaaagggatctgatatcatcgtcctgaccgccggcgttgcacgaaagccggaccagagcagactggatctcgctgtagagaatgcgaagatagtcgcggatttttctcagaagataggaagaattgcccctgactcatttctcatgatggtcaccaatccggttgacattatgacccatgttgcattgaaatactcaggaaaaaaaccaaacgaagtattcgggcttggaacacatctcgactcaatgcgtctgaaatcagcaatcgcatcattctttcaggtacatgtcagtgaagtgcatacccgtatcatcggggagcatggtgacagtatggtaccactctggtctgcaacaaccatcggaggaatacagatatcgaatctgcccagttttgcacaggtgcctattgatgacatcatgcagcaggtcaaatcctctggtcagaagatcattgcatcaaaaggtgcgacggtctggggccccggagaagcaattgccacacttatccgtaccattcttggaaatgaaaaccggatacttacggtatcagcctacataaaagctgaagtccataatatcggagatgtatgtatcggagtgccggcccggataaaccggagcggagtgtaccctgtgccaatccgcattgaacccctggaagtaaggaactttcagaattcggtagaaaagattcgtggcataacccgtgaaattttctcagttcttgagaacggggagtaaatatccccagtatccggagaatgaaaaagccttgtgcagatttacacaagggttgattctacaatttctgcccgttcaacaccatcgatagcattgagggtcgcttcaatggtctctgtctgaccttcagcatcaggaacaaccagcgcgacttttattgcgacaagtccaaagccgatgggctcttccctgatatcctgaacgcgggggaatttctcttttatagtcgcaacgatcgtttcccggtttacttctggtgattccggcatcaccttgatgatgagcgctacgtctcccataatctcagggtccccgaaggccgcaggtcgggcagatgtactcaacgctctgttctctgcaccggtaacaccggcgtatggtggccccgcatgccgggcagccgaactctacagagccctcttctgccattgggccattacatgatgtgcaggttgttctactcatattcagacttccaaaaagctgcttatctggtttattcatcaacaccttaaatggtaccgccaaagtatgtccccggcacctcttcacccctgagaaatcctgcaagtctcgcatgatcagatccccggagtatgaatcccctgacctgctccttcgtaacatagggaataaatgcaggatcgagatcaccggtaaccattccaggcatgagtgcggtggccggaccgtcagatgtccggatatgatcgagcgattttaaaatgacaagaggcactgagagcagaccggcatagaaggcactgatagtatctgatgtgatatcccacgaatgaggaagcggatcagcatccatcatatggtgataaggaagaagaattgcaggggaaccactcataagcggagtccaggttaccggcaatccatacgtggacaggagccatccatactgatccatggctgcgatggccataaaatgcgctgccgtatctgaaatctccttttccctgacaacatcagcaaaaatccccccacccggaatgaccagaatatctcttccactctctctgataaccctgacaatcatcggagcatgctcaatcagactgcccccaatcttgagcaccaatgcctgatcccggctgatcacaatgcagtacgttcatgtaatgatgaccaataaaccctgatccccatgtacccccttcctgttatcctcctcatatgcgtactgatgaccccagtatctgccgggccgtatttccttgagatttatccggatacctggatgaatggggatgaggatgaatacataaccattggatgggatcaccctcccggttcctgcaccatttcagatggggagggaaccatcacattttcaccctcgaactccggatcttcctcctgcacgatcgcgcgtaatggtgaacaatacaaccatgtatgggggaggtatccttcctatgagataattgacagcacccctgctgttccacaggcaacggtgcagggccggttccaactgtccaataaaaaggacgaactgactcttacatgcgagggatgcacctacgacaccgtgacatggcctgggacgttcaaaccaagaaacggtcagatacatttcaggtcggctggcggaatctgggatcccagggtgctcatggccggtggaagcagacttgaaccccggacctttgagaacatttcaggcacgggatttgtttctcctgactgctcaagagagatcctggaagagatcatcagcaatgcaaagagatccgttcttctcaatgtctacgaattcacagaccctggtcttgcacagatcctctgtgataccagcaggcggggggtagcggtatcggtgctcctcgaaggcgggccggtcggaggcattccatcagaggagttccccgtcatctccgatctgattcaggcaggagccgatgtcagagtcatggaagggaccggagaagatcatgccccgtaccggtatgaccatgccaaatatctcgtggcagatgacagccgggtatttctgacaacagaaaacttcaaggagcattccttccctcatgccggttttgccgggaaccgcggctggggagtcgtgcttgactcagccgatctcgcatcctgttttaccgaagttttccaggatgactttgacggaccaggagtggctgtcgcagaaggcagggccggcaccgccgaacaaccggtgacacccccatacaatccagtatttgctcccctgtctttttctggagcagtggtaaccccggtcttctcaccagacaccagcatcctgatcgcagatcttatcaatgaaagcaggagcagagtatggatagagcaggcatacatcaccgaatacccaaagaacgggacaaatccgtttctcgcagcagcagtagatgcagcgagacggggcgttgatgtcaggatcctgcttgacggatactattacaatatcgaaggggatgaggacaatgatgagatggtaaccgccctgcaaacccttgccgcacgtgagaatatctcccttcaggctcaggtcctctatcctgagaagactggtcttttaaaagtccatgccaagggggtgattgctgatgattcggtactggtatcgagcatgaactggaatgagaactcagcctgctttaaccgggaggcgggagtcatcatccacagcagggatgccgcatcatactttgcctccgtctttctgctggactgggcaggaaaaaaagagaggcagccggccaggagtcttcccggaagtgataccggatttatccagatgattaccctggcaggagtggtgatctttttactcctcctctaccgccggtatcaccggtgatcagagatgttctttgaggaacacaaagaccaggtaatacagtgcaaccatcagcatcaggaccccggctatccgattgatgagcaggtgatgtgtggtgaagaacctgatacagatcctgcttctctccagagacaatgctgaaaggaacaggagcggacttgccatcccaatcccgaagaggacaaaattgacaaaatttgcgatgaaatctgcagtcgtcgtggatatcgcaaagagcaggatgatagagcctggattgcagggaagagcaaccagcccgaagaatgccccaaacaggatggcagtaatatagggggtttttccaaccggcgtagataccataggaaaaaaccggctgatgtcaaatccggcaatcatggcaatactcatgatcgcaaggatgccgtaaatggcagggccgagtatctcaataacatctccggtggacatcttcaggatagccacaaaaagaaggccaaatgagaacatcgcaagcagcacccccgccgtcacggcaaggcccagagtgagagtccgacccccgccggtctttgtccgccctgcaaggaatgccaggtaccccgggtagagcggcaggacacacatggctccaagcggcgtataaagacctgccaggaaggagatggcccaggtttcaggtgtgatatccatattatgagcagagttcgtccagtgcccgcttcaggacatcagcacgaaaaaccccgtcttcaagataagtggccgtcttgtcacagatgatgatagtctgggggattgactgaataaatcccggcccataggctttgatcaggcttctggtcacatcagtcggggccgcggtaaatatccccttgaagttgtttgactcctggtgtcgcctcactttttcggcattatcattaggatccacatcaagtgccaccaccacgtatttatccggatatgcagtcagtaatttcgtagattctaaaagctgcatggaacagcccggacaccagacggcaaaactgtggatgataaccggctttccctgctcggcaagatcctttatggtgaaccgctcccctgttgcaacatcggtcatggatgtcgtaatccaggcaagttcaggagatgctgtttcagaatatgcaatttcaggtgattcctcacttgccagacatcctgtacacaacagggtcataacaaggagaccaaagacgaccgggagtatagtccggtgataactcatgcaacatcatctgagactctttgttcatatacttcaaggaaaataggggagttacctgaccggcatcaggaactgaatgaggagggcacataagtaggttacgattccaaagagaatctgcgggacggtataccgtttgaacacagttttcacatcatccccggttgtccggtgtaagagccagaaatagggatcggtcacgaaacagatgagacccgcaccaccgatgatcatgaggaacagggcaagcgggtttaacatggatggaataaccgtcgtcgcaaggacctgggcagtcaggtacgatgtaacaattctggacccctgggcagtctggatcagagcagcgaggacgaacgggaagaggaatattggcaaagatgttgcgagcagaatagaggcatcagccggaaagctgctctgctggatgatatacccaagagcccctgctccacagatgtcaaagatgacgactccgccatgctttgctccaagaacccagccactccaccggacctcctgttttgcagtaattaccgcggtggccattccggcgagcatgataaactggagaagacctgcatgagtaagcccgaggaggagatacccgacggggatggcaagaaagatcaccagaaacggtgcccatgcccgaagatgaaaggaaccctcttcgcgcttgtatcctatctgctcatgggtgatgtcagcaaaatcacactgtcttctgacataccagatcatggaaccgacaaagagcagagagagggggattgcgaccaggttatagatgagaggggagtaatccggtgcaaatgcatcaaagagggtgtaggtgaccggcgtcgggtatacatacgcaaccccgaggacagacccaatggcgacaagatagataagaagtgaccgctttcgttcatctgacgtgaagaactcgatgaccggtgtgagaataataaacgcagttatgggacaggtggaaggaactgcaataagatatcctgcgattccggagagggtgggcggccgctttaagagggtccgaaggtcagagacgatctgctggataagtccctgctcggcaagatattttgcgataaccgatccggcaaggatagggataccaagactgttaaaaatactggcacatcccagcgcaacctgctgaaagactgtatccggagatgacccgatcatcagaccaaaggcaattgctccgccgaccagagtgaaaaatggtggcagtttaaatttgaacccgatgacagatattgccaccatcacgataaggaaaatcaggatggtactcattccttattctatctgcaggtgatcatatcaaaggctcttggtcccatgaccccatgtctcataggtgaggacataaaacctgtaggagatgtttgtccttcaccatcaggagaagactgccattggaattctcatcctcgttactttggtctgccttgccgggactctcatgctggacgagatgggaaaagaacaattttcaaccgaatatgagaccggaatgacagatggaaccttggtcagatgggaaggagttgttggggaggtatatcacgcgaagggaggcagcgttatcatggacgtctccggagtcagtatcttcatcccgtcatccgcaggagatgtacctgaaatcacaccaggaacgtccatccggatcatcggtaccgttcagcactggaacggaaaagaggagatatcagtcaaagatggcaaagatatcaggattctttcatgatgtcaagagaaaagtctgcattgatgaccgtgtgggtgagcatcccaagacttatccgatcgatgttcagggctgcatatgacgccagggtatcttcggtaatccctcctgatacttcgataagtaccttctcccttaggccgttctctgaaaggagtgaaatgacctgtgaaacctgttcaggagtcatgttgtcaaggaggatgatatccgcccctgcctgtgcaatcctaagagcctcatcaatcgtatctgcttctgcttcaacccggtgataagccgaaaaggcttttgcccgcctgaccgcctcatccacaacggtcaggacccggtgattgtcttttatcaaaacggcatcggaaagggagaaccggtggggatctgcccctccaatcatggcggcctttttatccataaggcgcagtcctggagcagtttttctcgttgcggcaatacggcacccgggatttattgcagataccagatcctgcatcttcctggccctggttgcgatgccactcatcctcccgaggatattaagcaatgttcgctccagaagaaggatggtatgagcctggccggtcagggtgacgatcacatcccctgcttggcgatataatccgtctgaacatgcagaagaggcagccagaccataccattcagaaagccgtataacttcagtaagaccggcaagtacaagggattcccgtgcggatataaccgcagagcagatctgcggatctattaccacctctgaagtgatatcaccaaacggacagtcttcttcgacatattcgatgagtctggtgaggggtatatctgggagtgtattcatggcacattgatcatgtattcaagtgaccgccgggctccttccataacctctgaaggcacggtcacttcaccggagagatcgcgaagacatctgaccagttcatggagtgtggtctttttcatatcagcacagatcgcatcctccctgccgatgaatgactggtcagggcagagttcgctgagccgatccagcatccctctttcagtgcagatataccacgaagacctggttcttgcaatctcagccatcctgccggttgaggcgatataatcagcaagaacacgaatttcaaccgggcattccgggtgtgccatcaccgcaataccggctgcctttacctcccgcagatcttcaggatcaaaccgcatatgcacataacaatgacccccgtctggaataggaataatctccttctccggaagaaccgactgtacatatgaggcgaggttggtatccggaccgaaaataatctgtttatgggggaaagacctgactaccctgactgcatttccggaggtgcataccgaatctgcaacggctttgcatgctgcagtactgtttatatagacgaccacggctgcttcagggtactgctcttttgcctttcgtattatctccggcgtgagaaaatctgcgagcggacatccggcatcagggtcaggcatcaaaacctttttatcagggttcaggatatgggcagtttctgccatgaacctgacaccacagaggacaagaatgggttcattagcttttctcgctgcctgcgccagttcaagactgtcgccaataatatctgcgactgcatgaatctcggggagctgataattatgggccagaatgagtgcctttttttctgatttcaaacgaaggatatcggctatgagattacggttggtcacgatccgatcaccaggggactatcaaggtttttcaataatgagagcaccgaaagggctgcaagataacttgttgccgggttatccggacttggatggttgacaaccctgatacttgcctcaccgaattcgccggagacaaagatatcatgaatatttcgatcaacttccggatctgcccagagctccacatccacatcatgatgtacagccagcgccagtgctactgatacgttgatattttttggaaactgcttaatacattcattcgccttcccacgaaatgcaagggttcgatgactgacctgcatcccaagacttgcagggctttttgtggttctgagaaggactgaatctatcctgctgataccccccaccttcaggttatccagtcccatgatagcaccactcgggatatggatcttttttccctgggaccgtgccacatcaagaaggatttttctaaaattcgtatctgacagagcaccaacagagaggatgagaacatgtttcccgttctcaaggatcttcggggcatattccctgaccgcaaggaccgatgcagcctccacgcagatatcaaaatcctgtgatataaactcctgaaaatccgcgtatgcaggagcaccacacatgcgggcaagttcctctgcatggtccggtaggcggtcaaaaagcgcctcaaccgtaaatccatcctgatgggttgcaataattctgcctacattaccgcatccgaggagcccgattctgaccattgcctacatatatgcacaatatcttttaagccgtttggttcctgaatggtgagagctgtacccatgaacatatcagatcaggcacctgaaaagaagagaaatgacttgtttcttccggaaaaagaatgggtcaaggcgctctcaggtcgcccgatatgtatcagaacctttggttgtgcatacaatgtcggagattctgatctcctggcatcggttctcacagcctccggttcggtgatagtatcagatcccgaactagcggaggtgatgatcatcaacacatgcattgtcatcgcctcaaccgagcggaagatgctaaaggagatctcatcatatccggaccatgaggtatatgtgaccgggtgtcttccactggcactgcccgaaagtcttcaggagcatactaccgtgaaactgatacatcctgattctattcaccgggcagcagccactgtctcctatgatcagaaagggccggtatcagtggtccagattggacctggttgtgttggatcatgccggtattgtattacccgctgtgcccggggatcaatcaggagtaattcccctcatcagatttattcacatattgccagctgtgtcagggggggagccgttgagatccgccttgccggacaggacctttctgcatacggacatgacaccggtcagtggtcacttgccacgcttcttgagggcatccctgctctgccagatatcacccgaatccgtcttgggatgatgaaccctgctaccctgaaaccgatagcacagagagtcgcacggaccatgaataacgggccgttcttttcatttcttcatctgcccatccagtcaggatctgaccatgtgctggatctgatgggacgcggatacacggtggctgatgttcagaatatcatcgatatcttcagagcagagatgtctgacataaccatagctaccgatatcatcaccgggttcccaggtgagacggacgatgaccatgaagagactgtgcgtctgatccgtcggatcgctccggggatggtgaatgtgacacgatattcatggcgtcccggtactggaatgagccgggatcatgaactccctgaccggatacgaaaggagcgctcgcgtgcgatcatccgtgaatcatataccatgttccagaaggccaatgagaagatgaaaggggcggtgatgagagtaatcccgactgaacaactcaaaccaggttcagtcatggctcgttccgaaaggtatgaaggggtggtaatcagggaagagtgtcagctgggcataccctgtatggtgaccatcaccggttctaccccccattatctcatcggcgaagtgatcagggactgatcagatttttctttgcctttccggatgacctgtatactcatcatggaagagatcattgaacttggttttaaccggctggttgaggtaataaacctgcatgattcatcaatagatgcctattcggaagagatccggacccttgatgcagaactcctcggcaaaatggctgcacaggttaccggagtgattgcaaaaaccggtatcgaacttcttgaaaagggaaagaaagacaaccacggtgagatctatgatccccgacattatccgaaaaagatgataattctgggaaagagtgctgaccctatgccataccggccagataacatgtccagagccgttcaggaccagttctgtcttctcggagaggatgggaaattctatgagatcatgtacagtgctgatgatctgatcatcgactcatatcttgcagagattacgccacgtcaggttattgatctgtacggatatgaagccatgttcatgctgtacaaagcaatgcaacaatatatgtataaccaggaagaactgctctctgctctggaaacgacattgaactttatccgatcataagatcggctatttttctttccaaccaaacagcgggaacattggtttgaacggatcctgttctggctcaaacttgcccaggctgaaggccttgcttttccgggggctgtcctgaacctgatatgttacttcgacaatgagggactgaaccatcttcggaagggtcagtcgtgtcggagtgtcaggttcaagacggtctatatgccagggttcatctatacctgccgctgttatctcgaccttctctgcagcgctcgttccagcgttttccaggatgatctcccggtgatttggagagagatcagccagaatcagtgggcgggcattttttgctgcatcaagagatatcatggcactgagcagcagggttccggttataataattgcaataccggccagaatctgctggttcataaaatacaaaagaagcgtaagccctgttcctacaaatgcgataagaaggatatgataattctttgaattgaatggtagagacaacataaaacagaaatgggcccgatgcgattcgaacgcatgacctcccggttatcagccgggtgcaccacctggctatgctacgggcccgaggctcttatcaggtggatcccgctcgttaataatacttgtgataactccaaaacggccggatgatatgaacagaatatgactcatatcagaacaggcaatatacatagagaatcagatccgggtttttatatggttgttcaatatctcctgggaaatgaggcgattgcacatggatgccttgaagcagccgtcgatgtcgcctgtggatatccgggtactccctcttctgaggtgattgataccctgcggatggaccctgaccgcgcctgtaaggtcgaatggtcagtaaatgagaaagtagcgttcgaagaggcacttgctgtttcatggtgtggccttcgggctatctgtacgatgaaacatgtcggcctcaatgtcgctgccgatcccttgatgacctcggcgtatacggggacaaaaggcggatttgtcatcatgagcgctgacgatccctatgcccattcgtcacagaatgaacaggacagcaggtgttatgccaaatttgcacggataccctgcctggacccctctacattgcaggaggctcatgacatggttcgggatgctttcgccctctctgaagagttctcactcccggtcatgttccgcccgacgacccggatttgtcattcgaaaagtgatgtaaatctgggtgatgtcgtggtttctgaacggaccgcatcatttgaaaaaaatgccaggcagtatgtggtcattcccgcgcataccaggatccttcaccagaagctgaacaagaaacagcacgcactcaagaaaaggctcgtagaactcgggtacaaccggtatgaggtgaaagggaagaaagcagtcatctgtggcggagtcggggcatcctatgtcagggaggttatcggtccggatgtgtctgtcgcgataatcggtgcatatccaattgatgaggattggctcagggagtttatcagtcatcataaggaggtgatggtgatcgaagaactctcaccggtcatcgaagaggtcgcacgacaggtcagtggaaccattccggtgtttgggaagatgaccggtcatgtaccgtacgaaggtgagcttgctcctgaccgggttgcagggtacctgaaggctgcgggttttgccgtatcggtcacctatcaaccggcagcaaccccagccgcccttccggtacgaccgcccattctgtgtgccggatgtatgcaccggaccgccatgtatgccatgaaaaaggtctttcgggatgcgatattcccaagtgacatcggctgttacacccttggtatccagctgggaacagtcgacacgaccatctgtatgggtgcttcaataacggtagcatcagggatgtctcttgccggagagaaacgggatattgtctgtacgattggtgactcaaccttcctccataccggaatacagggtcttatcaatgctatatacaatggcgcaaacataacggtggtcatccttgataaccggatcaccgcaatgaccgggcatcagccaaatccgacaaccgggctgactgcttgcggcgttgcaaccccggcagtctcaattgaagcgatctgtcgggcaagtggtgcaacatttgtcgagacggtcagtccaaatgacctggtcaccttcatcgatgtcctgaaggctgcaaaagcccttcccggcgtaaaggttatcatcgcacgccagccctgtgtaatatctgaaaaacgttcccgggttgttcgtggccgctacaccgtttaccaggatcggtgcatcggatgtaaagcctgtatcaagttcggatgcccggcaatagaactgaaaggtggtcttgcatccatcactgatctctgttcaggctgcggagtatgtgtgcagatatgcccggttggtgccatcggcagggaggtgaaggaatgagttttgatgtgatgattgtcggaatcggcggtcaggggacaattctaacctccaacattctggggaaagcctgtgttatagagggcattccggtcaggggagccgagacccatggcatggcccagcggggaggatcagtcgagagccagatccgtatcggacaggagtttgggccactgattgctcccggcagtgcagatatgctcctctcctttgatctcatggaagcggtcagggcagcccactggttaaagccggagggtactatttacaccagtagggagtttgtaatcccgacctcagtctttatgcaggactttccagcaccaaccgaacagatgctgagagagatgcttggtgaccggccggcaaaaataattgattcacgggcattagcagaggaagcaggaaatattctgacacaaaatatcgtgatgcttggagccgcttcacccatgctccccttgaagaaagagtctttgcaggaggcgatcagaagaacggtcccgccaaagacaatcgacctgaacctcaaagcgttcgagatggggatagacgcagggaaaaactaaatcacttttttattgacagaatcattggagccataactctgtcattgactgatatgcaccagaattaatattttatttataaatatgatatgttgtggtgcaataagagaggataccattgcaccagagacccaaaccttaatcaggagggatgaaccatgtgtatgatcatgtctcaaaacgtaaccgggacagggaacgtcgtaccctcaggtacggcaggtcgctttctccagcgataagcagagcagacgaagaattactgttttcgacacgacactccgtgacggggaacagacgccgggtgtgtcatttacgccttcagataagatcgagattgcccatcagttatctgatatcggggtctacgtcatcgaggcgggttttccggcatcatcagccgatgagttctcgacggtaaaggccatagcagcagaagggctgaattccatagtgtgcggactggcacgttctgtacagtcggatgtagatcggtgcatcgatgccggtgttgatatggtgcatgtctttattccgacctcagaggtgcagcgggttcatactatccgcaagagccatgaggaagtggttgccatcacaggagatatcgtcaggtacgcccgtgatcatgcagacaaggtgctgttttctgctatggatgcaacacgcaccggcattccggagctgatagaggtatataccgctgcggttgaggcaggagcgactgccatcaatgtgcctgataccgtgggcgttgcaacaccgacatctatgaaggagatgattcgtgcattacgtccgaagattccggtgactatcgatgtccactgtcacaatgactttggcatggcaaccgctaacacgatatcagccgtagaggctggtgcagaccaggttcaggtgacggtgaacgggatcggagagcgggcaggaaatgcggatttagcctgtaccacgatggtgatagagtccatcttcggatatgacaccggcataaccaccgagcggctggtcgagacatcgcggatgatctcacggttctcaggtatcatggtcccgccgacctatccggtaacaggagagtttgccttctcgcatgagagtggaattcactcacaaggggtgattgagaacgccagtacctttgagcctggcatcatgacacccgagatggtcgggcaccgccggcgactgaaactggggaaacatgttggcaggcatgctgtccgcgagatgttaagccaggttcacatacaaccagatgatacccagatggatgagatcatcagtcggatcaagcatatctcctcaaaggggaagaaggtcaccgagcatgatctgtatgagattgctgaaaccgtgaccggaacctctgctggtgggaagtatatcgagctggtggacattgccatcatgaccggcaaccacatgatcccgacagcaacggtgcgggcacgggtgaatggggttgaggaagtatgtgcacgaaccggtaatggggcagtggatgctgcaatcagggcattaatcgggacggttccaaaaccagccacattaaaggagtttaatatctctgcaatatctgaagggagtgatgcaatcggccatgtcacgctggtggttgaagatgagaaaggcaggctgtttgatgccgccgcatcaggtgatgacgtggtcttagcgtctacggaggcgatgataaacgcattaaatatggtgtaccggaatggcaggaacaatcactgaaaagatattctccgcccggtgtgggaaggaggtaacagcaggcgaggtagtcatggcacctatcagcggggcaatgatccatgatatcaccggcccgcttgctattgagaaattttatgagatgggtggcgaaaaggtctttgatccggcaaagatcatcatgctttttgaccaccaggtgccggctgactcgctgaatgctgcagagaaccagaagaacatgcgtatctttgcaaaagagcagggcatttataattatgacatcaaagaaggggtctgtcaccaggtaaccctggagaaaggccgggtctctccgggcgatatcgtcatcggcagtgattcgcacacctgtatgtatggagcagtcggggcatttgcaaccggtgtcggatctaccgatatgggatttgccctccggtacgggtgcctttacttccgtgtcccggagagcattagggctcatgtaaccggcagattccaggaaagggtcggggcaaaggatctcatcctcaatatcatcaaggatatcaccgtggatggggcgacctataagacggttgagttcactggcgataccatcgaatcactgaacatggccggccggatgacctgctgtaatatggcaattgagatgggtggaaaggcaggtattgttcctcctgaccaggtaacaaaagaatacctctcaggccggggcacctggagagaagagaacctcgcaagtgatccagatgccgtgtacgcctcatggcgtgactatgatgtctctgaccttgtaccacaggtggcagtccctcataatgttgaccaggtcgttgacgtgaccgagattgccggaacccatgttgaccaggtcttcatcggttcttgtacgaacgggagatttgaggatctgaaagaggctgctctcgttcttggggataggaagttctcggatgatgtcagggtccttgtaatccccgcatcaaagactgagtacctgaaggctctgcgggcaggacttatcgagcagtttgtccaggccggagcactggtcgaggcaccctgctgtggcccctgtatgggaggctcctttggtcttattgcgtcaggtgaagtctccttctcaacatccaaccggaacttccgcgggcgacagggatcgacagaaggaaaggtctacctgggatctgcagcaaccgctgcggcaactgccatccggggagaaattaccgatccacgagaggtgcgatgatgaagatctggaaatttggcgataacatcgataccgacgccatcatccccggacggttcctgaccatcaatgatcctgcagaactcgcaacccatgccttcgagggcatcagggatgagttttcaaaggaggtaaaaaaaggagatatcatcgtcgccggcaggaacttcgggtgtggttcctcacgggagcatgcacccctggccctgaccggtgccgggattcagatggttgtagcccaatcctttgcacggattttttaccggaacagcatcaacgtagggcttttaccggtcatctgcccccgtgcatctgagatcagtgagaccgatcaggttgtgcctcatcttgatgagggatatctcgatgtatcagggaagaaactgcccactgagccggttcccgagttcctcagacggataatcgacgcaggagggttggttgcttatgcaaaaacaatacggagtgaagacctgtgcataaagtagcggtaatcggcggagatgggatcggtcctgagatcatcgagtctggaaagactgtccttgaagctgcaggagaaaagttcgggtttgatatcgaatggacagaatttgatatcggagcagaacggtaccttgcaaccggcgaactcctgaccgaagaagacctgaaggaactggagaagtataaggccatctactttggggccattggcgatgaccgggtaaagccgggtatcctggagaaaggaatccttcttaatctccggttttactttgaccagtacatcaacctcagacctatccggatgcttgccggggttgagacaccactcgcacacaagaggccggaagacatcaactttgttgtcgtcagggagaataccgaggacttttatgtcgggatcggatcccggctgaagggccgtgaaaagaagaccctggaagtgaaaagggatatctattcggtgaaattcggacttgatgttgagaccgatgctgatgaactggcataccagataggagttatcacccgtgaaggtgcaagccgggtcatcttctatgcctttgatatggcacagggcagaaaaaagaaggtcacttcggtggacaaagcaaatgttctgtctgatgtgtatgggctctggcgggatgtattcctcgagaccgcagagaagtacccggggacagcccacgagtttacctttgttgatgccatcaccatgtggtttgtcaaaaacccggagtggttcgatgtggtcgtgacaccgaacatgttcggagacatcatcaccgatcttggtgccatgatccaggggggccttgggcttgcaccgggcgggaacatcaacccggacggaaccagcatgtttgaacctatccatggctctgcacccaaatacaagggtcagaatgtggcaaatcctctcgcaaccatctgggcaggctccatgcttcttgaacacctgggtgagaaggaagcagcagataaggtcctccagggcattgaagcctctatccgggaaaaaatggtaacgaaggatatgggcggctcagccagcacgagtggtgttggtgattggatcgcatcatggatacagacctcataacccattcacactcttttaatcaggtcatccagctccattagataaggcattattccggtaaaaccggctcacacgctggcatatctcgatatttccgggcaaaagcacctattgttgcgggaacctcacacaacaaattgcgcgtttttcctcaccataccacgtgcattttccctaaaataggttcctgaccattatcgttgtaagggagcactgacatgccggagcaaaccgacgccggcatcttgcgaagtctacttgacctgacagaagaagaatgggacaatgggtgaaaatgggattggcaaagagagatgccatgatgtgcggacttaccctcaatacttcctgatcaccagggcgccatcagtcgtccggcagatgctgcctaaagagagatggctgtcagaagagcgggcgaaggatcttctgcattgaaggtgacatgaacccgtacagcgacccggctatcacaggcagccatgcaaggatcttatcccgtgggatccctgttgcagcgcagtacttctgcaggtacatctcgctcaaatctttcttgtcgatcaggaggtagtccatgtaactacgagcaacatccgctgccgggtctccaacggcgacttccgcccagtcgatgatcttgtagcccttgccgtcaaagagaatgttgcccccgtggaagtccccgtggagaatcgcaaagccatccggaaactgttcgagcatagcgaggagtttcttccgctcggcatcatcaagctgtggggctccatagatgttacctgcaagcacgagtttgatcgggcggaaattggcggaagacactttgtgcatcgccacctggagctcaacgactttatcaaggcactcgctggtcttctccggtaatcgcagcatcatgtctgcgagggactcaccttgtacctgctccatgatgagtgttgtccggcccagaaacgtctcgacaccatacacctttggaactggaatgccctgttcctcaaccgtgaccagggtgaaagcttcctggaagacctgccggcgtggctgcccctcccggtacaccttggccaccctgccgtcgcgggcatatatgatcgcggacagcccgctgccgatctgttctccatagcgtttctggaactcgctgtcgttttccattgatggtgaagggtgtgagctgtcggtcataggggttactcatcctgtcagaaaagacctgagaatattcttgatatatgttccagacattcctaaaggcttcgatccggagctcaaataccgcatgcaagagtgcggttatcctgccatacaggaaataaaaacggaataaaaaactctccaatttcccttgcaggaaaggaaaaatatccccctcatgcgtgcgatggcagcatttcgagggtatatgcaaggaggaagaggagcaggccgttgaaaaagaggaccactgccgtcaacatgcccgggataaggcccgggaacagcatggaggttccaaagaggataccgataatgttgagtgcggtctgggtgaccagcaggttccggaccggtgccggcaatacgaccggctgcgggtgctcttctctcatggccattaccatgggcacgattcggcttgtaaggaggacgaggctgccgatcaggttgaggagcccgagcaggacacgaaggagatcggtaaggattcccggtacgatacaggaatatacgcccatcgccacgaagagcaggccaatggcaaccaggaacatcgagcgccggaactgtccgagaggagtctcgcccatggcaaggatctggatggccatgatgacgatcagcagcccgagttgcccgtctggtgagaatgggagcattccgaggcttaccggcacgagcagcaccgcaagcagcgcaaggagcacgccgaggaagataaggagggcgagggtgagggagagtggtgcactctggaaaagaacagttctacctccgacctggccagcctgtggtttcttcgggtactgtctggttactgcttcgatgcaccacgcaagccagaagagggctgcaccattgataagaaggaggacggctgtgattgtattggttgtgagggcagggatgagcgttacaaggccgagcaggaacgccatcaggtaaacgatagcacaggctgcggtaagctgccggaggatacccgggacgcgaagccagagtgccgctttgtctttgtgcaggaagagctggatgaggagggatgccccgccaagcaggaggagggcgccgaccagtatccggacgatatctgagaggaaaccggggatgaagcaggcgagcatcccgatgattccggcggcgattccgatcaggatgaccagccacgttcgctggacatcaccaatcggtgtcttccccattgtgatcacctgcagcgcaatgattacgaggaagagaccataggtgctgtccgggtcatagggaagtgtaccggtagagattgggaaaaggagcagcccgaataggcccatgaagatgccaagcacgagcaggatcacggattcgaacgtgaaatcgaaatctttggcaaggggttgagctgtatcgggtgtcatggtaattcagtctccattttatgtccttccgttacggaggccgacccgggcgcaatacccggtctatggaagagatctcttccagttatcctatttgtgagttattgaaatggatgaatattgccaagcagggcttttaccacagactaggggagaggtggtggaccagggtgaccccaccggcccgcagcctctccagactacggtacagaaatatcccttggatacgctggagttgcggaaagataaatttttaaaaatttttcatggttgcaatgcaaatttgatatattttaatcagatattaatcggcaaataggaaattttcaaaaaagataaatataaaaaactagcataggacgcatacatgcgtatcagcaacagagatgatgggctgactcaccggatgccggcccatttccggcattggacgccatcaggcttggggatgtgcccctatgatgactgtacaaccattgaattaagttacgtgactgatgaaaccaggcttcgtcagtatataccagaggagtttacaatcaccaggccagtccttctcattatgtatgaaaaatgcaacggcgtccagtggatgggtggctcgcaatactcgctcattgcggtctcggtacaggtgcagtataccgcaggatcggagccgattgacggggtctatcatctcgtgctctgggaaaacaaggccgagcccatcctcggcgggcgcgaggaggcgggtatgcccaaggtctttgctgatatcccagaatatcgcaggataggagataatctctcggtaaacgcgagccacgaagggcggacgttctttgagatggagctttccatagggcgagcatactccgcggacgaactggcaacgcttaacaccaataacggcagggcagtccagttcggatggcgctatatcccgaagataggtccgtatgccggccctgctctctcagaggcaacgtattacccggtggacaacacttatacatccgcctcggtctgcaccggctctgtaacatggaccgttccttcgttaccgcagcacccgacccagcacgacatcatcgccgctcttgcggccctgcccgtgcgagagtacctgcctggctcgctgcggaaagggacaagcaccatgcgtatggatcttgcacgatcgctgccgtgaggtgatgattgattgatcgactcattcgagggtaaggttgccattgtgaccggtggtacatccggcatcggctatgcggtatcagaagagttgttgaaacgcggtgcaacggtctgggtgatcgggagcaggcaggagagcgtggacaaggcacaagcgtcgctttctgcgtttcatcaagcacggtttgcggcagtggacgtccgggacaataccgctgtacagaagatggttaccgactgcgtccgggaggacggccggctcgactatctcttcaataacgctggtatcagccagaagaacccgtacgaggcgagcacccttgaggactggaaggagatgattgacatcaacctctggggagtcatctatgggatcaatgccgcccttcccgtgatgaaagcacaaaagtccggccatatcgtcaacacctcgtcggttgcagctctctatggcacgccataccaggcgctgtacgtggcaaccaagagtgcggtgctcggccttaccgactgcctgtattacgagtacctgccggagaacatcctcttttcagtcgtctgcccaggcgatgttgcaacgcccatcttcaaaggccgggtacctgagggcgcaataacggctgaagaagctgcccggattatccttgacggcgtggagaagaaggaacggatgatcgtcttccctgaatctatgagggatctggtggagaaatgcaaggacccggtcttccgtgacttggcacataaaaagaccgaggaggacagccgtgctttctttgcgtcgccggaataccaggagtttctggcgcgacagaagaaacgggggtaacagccttcttgaggaggagcgggattgccctgtgcatccccgtggaatgaggaggtatgacaatgagtgatgtatttgagggaaaggtagcaatcgtgaccgggggcacatccggcatcggttatgcagtatcagaagagttgctgaaacgcggtgcaacggtctgggtgatcggcagccggcaggagagcgtggataaagcacgaaaatcctttgccgcctataaaaatacgcggttcctggcagtggacgtgactgttgccgaccaggtgaaaggaatgattgatgcgtgtgttgaaaaagatggccggctcgattatctcttcaacaatgccggtatcggcatgacgcacccgagccagtacctgacgcttgagatgtggcagcaggccatcgatctcaacctctggggtgtcgtctatggcgtccattttgccctgccggtcatgcttgcacaaaagagcggacatatcgtgaacacgtcatccattgccggaattgtcccgctgccttcccaggctgcgtactgtgcgaccaagcatgctgtcacagccctgaccgagtcgttgcggtacgagttcttcgaggagggcattgcatttacgaccatctgcccgtccaatgtcgcaacagcgatcttcggcaaagctgacataccccaggatgcgatcccggctgaagaggcggcgcggatcatccttgaaggggtagagaagaaggaagggatcgtcatcttcccggcgtatgtaaagaaaatgtacgagcgcgccctgactgaccaggcgtttaaggagaagttcttactcgaatatgcccggcgccgcaatgacgggtggagacggggagtcccctatctcggcgccccgatggacctgatggaaatgtaatgacggggagaattttttccccattcctgtcaattccccagggatcctgccggacgaagtaaacgtgtaacggatctggcaattacgttctggtacgtgacggtttttgagactggtagccgtccatccacgacaagtgtcgattcggagatggacgaggagagtaatcgcttcgtcaccgacctcctcctctgctgatggagactgccgtccggaaaaatgacccttgttattgaatacccaacccttttacctttctgcatgctcatccacccgggttcgccccctgattctaccaattttaaagagatcatggatgagttgaggaggagactcatccggaatggagatttcctgatttttgacaagcgctatttctcctcgaagaatgaccagataagggttccctaaatacaggatcgtgctgcccatattcccgcgaaataactataaaaccgggaaagcgttcagtaaaatgtgccatccgctcactgtgtattcccgacacgatggaaagagggtgaaggcggaatatgagaatctagtctccacgttgaaacgtgagttgaacaggtggattgactatcttgatattcgtttattcatccgacactcggtagcaacgagtgttacgaaattaatttttagtacaaacatttaaatctgagaacgttgtatactcttcttgaatactgtccatcgttgctgattcaaatgcaaccatcgctcacttgggcatagtatcagggataatagacaaacttggaatttgtgaatacattgatcggctcattcccaaaaagcgtagccatattgtcactcatggcgaggcagtgaaagcattacttctcaattgcctgggttttattgaacggcgcctttacctgatgccagaatattttgatgatattgcaaccgaacgtttaattggcgagggaattgaagcaaagcacttgaatcattacttatttggcgtaactttgatgcaatagccgctgtaggacccacaaagttgttcaccggtataatccttgataatcttctccatggtgttcttcgacttcattatgatacaccaacaatcagtgtaacaggagagtatgatcaagaactaaatactcgtctgattaagctggttcgagggcattcaaaagatcaccgcaatgatttgaaacagttagtcctatgtttagtaactgatcaacgtgggattcctgtttttattccattctgaagagagacataaggccagcatcaaacatgataataaaaatcgaagagaaactggcgaaaacagtttatctgattaattgcaactcattgagtacaacaaataacaaaatatcattaaaaatccggtatgtccgatttaccactttgacaggcactatccggcctactcatcctcacagaccaaaaacaaataccggaatctgggacagaactggggaagatatgaccgatattaactacatcagcatgcataaaacccatgaatctaacaatgaacatctcttatctgcatcacccaccaaccacacacccatcctgtccaaagaccatgtcacataaaggagatctcatgaccactattcagatacccaatgaaaaaccctggataataaaagaccagcggatctcattccaaggaccaggaaatctgataagaggagcagaaacctgcatgtatatgtcactgtcggattctgttatgcatctatgcacatctatgcacgagctatgcacacaaacgtgcataacaaagaaggtcatggttcagatgttttctaaaaatattgatgtatgtaaaatttcaatgctgctatgcacttttcggaaggtgcaagtacacctcactggaaccataacgaagccctcttgtacgatcatgaaaaatgtgcatagacccctactaagttatgtaattttagctattttagaatttatagagattattaaggttttttgctatgcacaccagcgtgcataaccggtgcatagctgtgcatagcatgcatacaccccttacatactgtgaaagatactaaaaccatattgatacagaatagtccctacagagatctatgtgaaatgcggaaaacagtatctccgaatgaacgagtaagtcgagaaagtataggcttaaaatatgtttcatgaagaggttttggtgtttgattactatcgacaattgtctgatatttgtcgacctacactcccatgtatctgctccatgaaagtggctaccattcctatttcatggctcgtgatatcgagcatttgccaattcatagatttcaagtagaaattgtttgaacggaacttcctccttataaagcgcagtccacaaaagttgcaaaacttgttcatatgcaaaaaagaagtatcgaattttcatatctttagattttgaagagattctcgcttcatcttgaaccctaaatcctgtttctattctccatcgtcgtttgtatgatggaataatcgtatcaaggtttatttcctcctgattggtagcaaatgcccaatcaaaagatttttgggactttttatcaaatatttgctttaaaagggcaagggttgtctcccccttgatgactgtcatatctttgtttaatttaaagcagtaggttattttctttttttctgattcttttaacgattcaagttcttttttgattttagagtcttttttaacgaatattaggtatggaagtgatgcatgggtaagagttaacatgagatccttactgtaaaaaccccggttatagatgctcaaaatcactgagttaatcaatggtttaattatcgtaaaacaccatgcaaccatttgtgccatgcaatggccttgcactacgggaatcgagattagggggattttttcaggtatatcactatttattattgaacaagaaagaaacttgaatttgcctttaactgcatgttctccagtatgaccatgaatccataaagtgtttatttcgccataaaaatcttcatccgtgtagtcaaaagctaaaaccacatctttatcttttaaaccaaaccgagaacctactgtttgaaccgtatcacgataggcccaaacaatgtctgatgttttcaccttttttatcgctaaatgaatactatctgctctattgccaacagtttcaagatatgaatttgctaccgctgctttaagcaaatcacgattgtactgaaatccggacaatccttttgcagggtactcaatatttagtgcacgatcaacaaaaatatccaatgtttttagagttctaaataacctactctgattcagagtcattttataaccaaatagactgttttatcgagatattctttaggacaatctacttttgccccattcccaaattttgtgacttttctgaccaagtacccctggatgccttcaattgtcaatctggtagatggttcaatgtcaatggttcgcatagtatatacaaagtatatactttaagatatttaaagtttcgttgaatgtcgttgacaaaaaaatcactacagaagaaatagttcagtttccaatggatgtatcagattctttcggagatactggaaagatagtaactattatttggcatctcctaaaaaataacgagtactatgatgatccgttgtttccaaggaagaaggttcaaacaatgaataaggtaatggtacccaaggaagtatcattagagcaacttttagaaataattgcaaaagcggacatcctaatcaaagcaccagatcctgatattttatgatttatcaaataattattttaaggaggtatttcttagaaccatacggattttcataggaaatattctggcatcaggtaaaggcgccgttcaataaaacccaggcaattgagaagtaatgctttcactgcctcgccatgagtgacaatatgactacgctttttgggaatgagccgatcgatatattcacaaattccaagtttgtctattatccctgatactatgcccaagtgagcgatggttacatttgaatcagcaacgatggacattattcaagaagagtatacaacgttctcagatttaaatgtttgtactaaaaattaatttcgtaacactcgttgctgccgagtgtcggatgtaaattttatactctcttatttgtctcgtttaactccaacaacataaaagtcattgagattatcgaaatcagcgggagtataaaaatttgtattttgatggggggaactttcaattctgcaataataaaaaaaagattacatcttttttcctacgactgtataatttatagtcagaaactttggaatagctattaatctatctaaacctcttcctaatatattgaatataggaatagtgatctcccgaaaaatcggaacacgcattgcataaaagcataaaaattgaaaaagacagagaatggcccccccgttttccaaaatctcaatttgaaagcggggtgaaaaaagctttaaaaggccggattcagtccatcgccaatgatctccatgattaaaccaaattccatgcgttgataagattacaataccccttggagcgagaactcgatatatttcagatactaaattaatgggatcatcaacatgctctagtgtttgagtggagattacaaggttaaatgaattatttcgaaatggcaggaattcaccgatgccatataagtctcccgcagaagtatcaattccaatatattctattgcccaatctttaaaaagagggagatacggtttttcaccacacccaagatcaagaatacgatatttctcgtctggcatgagtgtattttgaattgcatataaaagtgttttttttagggcagaaagcgtaagataactatgcattctgatagaaggttgcaaacggttaaattccatatgtaattatttccatgtgatatttcaaaaaatattttattattcgatcttattagttaatatgaaatttgataatgatgtttttgattatatttctggatctcaattttcaaatggtgcatcaattaaaatagccaaatcgaatgagataatatataataggtttcaattgattgaatcactctgtgcaaataaaaatattattcatcttggatgtgttgaccatttacctttaattagcaaaaaaattgaaaaaaatacctggttacatgcaagattatgtaaagtcacaaaaagatgtcttggtatcgatattaatattgaaggtatcaattatcttaaagacaaattgggttataatgatgtaatttttggagatattgcctatgaaaatattggtgaaatccataataatttttggaattttttagttatgggagagattcttgaacacgttgataacccttgtttttttctccaacaaatacgtgaaaaatataaaaataacatagaaaaattaataataacagttccaaatgctttttcatggcaaaattttataaacgttttttatcatcgtgaactcataaatactgatcaccgatattggttctctccatatacactcgcaaaaattctttttaaggctggaatacaagtagaagaattttatttttgtgactcgtttgatagagattatagaatgaaattcatcattagtcacccaagtataatatttcaaaaatttttattcaaaatgtaccctgctactcgattaacattattaatggttgcaaaattatgattgaaaaaatgaatagaaatctgatattaataactgatacctacccatttggagctgttgccgaatcattccttgataaagaaataccttatttaagcagcttttttaattctattataattgttccgcgcaattttcccgctgaaattgaaaaagttgaaagaaaaatgcctgataatgtagtgattgatacatctttattgaaatatttcactaataaaaaaataaaacgtattttattcattaaaattattgtgggatccattttgttttataaggaaattttaaaaaggcccaaaatattttttgatattcgtgcattgaaaaaaaccatttattatcttctgtcagcttatcttgttaaaaattgggtcctaaacttccttaaacaaaataactccaatttatctcaaactttattttatacctattggttgggttcgtctacgatgggtgtcaatttagtaaaaaaagataataatttgataaaagtaatatccagagcacatcgatatgatatatatgaagatctatatattccgaaatatttaccatttagaaatgaaagcatgagtattaacaggattttttgcatatcaaatcatggaatgaaatatattatcaatcattatccattcttgaaatcaatatgtagtatttcgtatttaggtgtagaaaaaccggattttatttcccaaccatcattcgatagtatatttcgaattgtcagctgctcttatattgttccagtaaaacgtattcatcttatcatattggccttaaaagaatttgcaaaaaaacgacctgaattaaaaattaaatggacacatattggttatggccgtctttttgatcaaattaaaaaagaagcaacctctttattaagtaataatataattgccaattttacggggtatctttccgataatcttttttataacttttataaaactaacccgatagacgttttcatcaatgtcagtgcatcagaagggatcccggtctccatcatggaagcccaaagctttggtattcctgttattgcaacggccgttggcggaacacctgaaatcgttacagaagatgttggcattcttttaagtgaaaatccatccccggaggaaattgcaaacgcaatcgaatttttcattgataatccggaaattactaaacgtatgcgattaaagagtattgagaattgggaaaaaaactttaatgcagtgaaaaatttcacagaattcgcaaagactctaaaaatgatataactgattatatttcaaaatgtcttttaagtgctgttaaaatatttcggaatcgtgtatctgtgataaataattgactataatatataatgcaacttaccaaagcgattatagaaataataagtggagggattttcattattttgaatattaataatggaataagaaataaaaatgagaaaacaacgacttttattatcatatttagcgaagaagaaatttttaatccagcataatgtaagaaaattaagcaaccaaaaccatatactaaaacacctgaaaatgaaaataaggctatagcaatatagatattccccaaaaagcctcctattaaaagggaactgattcttgtgcttaaattcaatattgttaaaaaaaaacccattctcagattttcagtaacagaaagaattgtacttaaaggcgaagagatgaaccaaaatattgcccatatcccgagtaattgggcatatataccggcctctccccaggtatcaccgaatatcactgtaaataaatcccacccggttattgtgaggagaagcattggaaacacaccaattttcaataatacatcgaaaacttcagccatgagtattgatagggtacctttgtgaaaatcttctgctgctctctgaaaaaatacctgggcaattgctcccccaatcagactcatcggagtctgtagcactctcatacctagtgcataaaatcccacgattaccggagagaaaaaggcagacaggaggagcacgggtaattgccaggagatggtattcaataacgcagatgtactatcgagtaatgggaattttttatacctctttaaaccataaatcatgcctttccacgagattttctccttgatataagccccatcatcccgccagatctgtcccccaaggattcccgtcgaaatagccgaacctgcaagacttgcaccgatcaaactcccgccggtggcatacccggcaaatcccgcaccaagctgtgccccggtcgaggttattacgctagtgacccgtgcgatagagagccttccgtaatgtcgtgtccgggaattccagtaattcagcgcgaggaacagtccactgataaaaataaacggggggatgagccacaggtaaggtgcgagatcccgggcattcagaagggcaaataaagcatcccctcccagtaaaaggccgatagcggtgaggcctgtaataattgtcaccattatgatacaaagcccgaggaggtttactgcatcttcatcatccttggggagcatgattgcaagctcgtatcgcatacaggcgataacaccgatgatccccgtgatggatgtgaaaagtgccaatagaccaaaagattcaggaccgtagaggcgggtgaggagaggagatgcgataattccaatcagctgggcaaaggcggtcccggtcaccaacgtaaacacatcttttgcaaagggagatgacttcctggggcggtcctgcgacatgaaattgatgtaattattgaaaataccggggtaatataatatcgactaatgggggaccgccattttttatttgtggaattttgggtgaaatgaaggtgatagatatattaacagatggaataacactacatttctcaatactggactagcataatttccccccccccttcagccgggaatatccctgattacgacaaagacctacctccatctcaccacgggatagaccggagatgaccgcgtgcatggcccgagtcgggcggtcgcgaatacctcggaagccacgtccctgttccacagggagatcggcgaactgcgaaaaatcccccggacgatcttggctcatcaaacctctgggtcctcaccaaccagaagctctggcgccgagactaggtgtttcccggcgggatcgcagaagcggaggtgcctgatgtggtctgagtgcgaagacggaatcaagacggagcggaaagtctacctcctcatgccgggtccccgggaaatcatccactgacagtagaaaaaccatgcagccgcccacccggtccgactcgaagacgggacgctctggttctgtgggatggtcgaagacgaccccgccggcacaggggaaggaccgtgatgccttttgtctgcatctcgtacacccacgaccctttcctcctcagctgccaggtatgcaacgatctccaggtttggatgatttgatactcttaccacattttctgcaatacattttcgtgaattattttcggcattcacaagcccaaccgtgattaccgtcattgctgtgtttgactgaacaagtgtcgtatcagtgcatctgaatgatctcatggaaacgagccctgatgtcccattgcagggtgtacgagacctcttctgggcaatatgcagaatatcacctgaaaactcttatattcaagataaaaagattaaaccggagaaaagagaaaaaatcaggcaattgtacataataccatatgatcaccgcaaagataccacgggcaagcagactgccttttgtgagaacttctggttccatggggtatgtatcggagatttttgtagtaacgtccatcggaaaaagtttcagagcctgaattcggcaagatcttcttttaaccttaccgaccggcccctgacttcggatctctctgccatgacattcccaagtgacacacatatctagagcgattgacgcaaggccggagatcttatgctcattttcctgtccgatgccacagataacattaattccgccacttttggcaagcattccgaccagatcctgaatacttctcttacacatccggtaagcatcccgtacccagagcatgtccacaagacagatgagctcatcactcgttttaccctcctcattaacataaggaatagcaaggaacgcaacttcacgaacctaggacggggaccggcaaatggcatcacctgaccatttattctggtttttgaagaccttagtggtatcaaatttataactaggataaaagaacagtacttttctaatcagacaactattcacacatatgggctttgatgcttccaaatgtgatttctcccggtgcaaaggtgaatgcctgacaaagtgcccctatgtctcgtatgatgagaaagaggcaaaaaaccagatcaattccctaatcaaaggtgatatgacacctatcctcaaagagtgcatcacctgtgccgcatgtaatgagtactgcccgctcggtgcaaacccctgggacctgatcctctggcggcaggaacagacccaggtactgggaatcccaatagatgcaaaacctgcatcagactggctggtaaaaccaaagatggtcagaactggaaaacccggcggggcactcatatcactctgtggtatttatgaggttgttccccagcaggaattccttaccggcatgatgtttgataaagccaccctcatcggtggaggggagtattgttgcgggtttaccgagacccatctcggacgcggttccagaccatatgaattcctcccgaccctggtcagaaaccttgccgatgctgcgaaagaatacggggtatcagagatcgtattcacccacgatgcctgttataacgtgctgacaaccatagcgatgcagcagcgtatcgaggttccattcaggccaattcatatccttgagtacatcagaaactggctgcttgatcacacggacaaaattcgccctctcaacatgaagatagcctatcagggaggatgtacaacccggtatgcggcaaagggaggtgagacctggaaagactggcttatagagatcctaaaactcgtcggtgttacctgtgttgaggacaagagaaaatataccgggaataaccggctgtgctgttgctgcagtatctttcatacccagcatgaccgggcgatgaaatttcagcagatgaacatacaggacgccattgatgccggtgctgaagggtactgcttcatctgcccggcttgtgtctcggttatgcggatgacctgcaaagagatgaacctgacaccctattacatcacccagcttgtaaagatggcactccacgaggatttgggaaaagccggcactgcagcattcggataccccgtgaagtagtgaaaataatacgggtaccttttattttccaaatgtatagtatcatgagatatggaggattttcatggtcatatttaccagggagatgaaggatgccctgcgtgttccgggaaaaggtggaagccttatctatatggcaacgagcagtcttgacggaaaaccaaatatcgcagcaatgaggtttgtggcaacccatggtgatgacaagatcctgatttcagatatgttcctgctcaagaccaagatgaacctgaaggagaacccggaatgctgcatcgctatctgccatccgcttgattcaggaagagactgggtctttaaagggaaggcaattgacatcgaatacggctttcctccggattttgactggtacggggtaacagcaaaagagatacttgacaagtggggagactgggccagccttgaaccacccaaagaggttccacctgacatcgtatttccaaaaccggcccagcgtggcgttgtcgttctccatgtagaggagatttattcaatagagaaaggaaaaaccggagaacgcatccagtgaggtgaaaagtatgtcattagttctgactgagcggatgaaaggatggattgaactgatgggatgccacctgtgtgttgcaacgccggagggcgtgccttgggtgaccgtatcacggtttgcaaaagtcacaaaacccgaccagatctcctttgccatggagaagggtgagatcggtgtcatcgaggctgccctttcaaagaatccctgggtggcaattggtgtatcaagacagggaggtatccgagccccttaccagttcaaagggagaggaaaagtcatcagatctggagaggagtttgacactatcaggggaatggcaacagggattgataccgacgcggtcctgattattgacctgaccgaactctactgtacaaagcccggagcagaagccggacaacggcttgatataatgtctcctgatgcagtcgatgcatgggagaaggcccggtggaccgatattccaggcaaatagacagatttaaaaacatcttttttcaacatttccccgaaatgggagaagaagacaccgggaaaaccccgaacaaattcccctggtttgaaccctttgcctgtgaagggtgtggggactgtattaccgtctgccccaccggatcacttgaactcctcgataacgagaatcagaaagttcccaaggcatgggtaacgaaccctgacacctgcatcgggtgcggcaaatgtgcgaaagcctgtattgtcggtgcagtccagatgacacggtacgtggatatggcaaagaaacgatataaggaagaagagaggccggtttagacacgctcgtacgttgcctgaaaggattcaaggagaacttcctcgtttaatctgccaaaatgatagatttttccggtggtacagtcatttacggtcagttctgccggtgagaatccaagatatgaaccaatattgacaatatcataatttgcatttctgaacagttcataaaagggacgtccgtacatctctgaattgtcagacgttatccttgagaagtcatctgaatagaaccgtgtggagataatgaccgatccataataaatattacaatcattggtcactcccatcgcctgttcaaacgtccgtttcaccggagcaaccggggaccttcctgctgcattgacaatattggagagatcatagcccatatcctcaagcttgtgcatggccatggtgacaatccgccctgatatctgaattgaaccgactatacttctggtggaggcaacaagggcataaagacaggatggttttaccccgcacttgtctgctatatattcacagacttctgcatccggaagcatccctgcctcaagtgtaataatggcgacgtccgaggtatcataatactgaatcgcctgatatgttccttttggctttaacgcaagtgcacgggccggtccagaccccatcgcaaagaagcggtttcttttaatgacccatcctgccttctgagaaccaagacaggcgatgatcgggtgcttcacggtcaggtggacaaaaggaaaaatctgtcctgcaatcggctgatggacgatggtgggttcaattaatcccccggcgcagactttcaggaattgcaggccggcttcatggcacccgttttccatcaccccgcagtcaatcaaagtagcgccgttctcaaggctatgaacttttatacccaaaatctctgcgttgcgtatcatatcaagcacaacaggaagggcattggtatttacactaatcatacgaattaggacaccagtctatcggattactggttccaggaagataaaaccccatcggttttcttataggatatattcgatggcgaaatcagcattagacatacaatttcgcagttattgttcagattcaaaccgatacatcgctctcggcacagagatctcaaaccgtgccccttttccatactcaccggtctcggtgatgctaatcccggtcattgccaggacctctgaaatgaagtagagaccaaatcccgagttcttcccgtacccaaggataaatatccgatctttttcctctgaaggaatccccaccccattatcctcccatatgatcctgatcccctgctcatcgattcccatgtaacaggatatctcagtcacatcacccccatgattgaccgagttatgatagaggttggcaaagacatgatccagcatgggatctgcatacaaggccagatcctgtgggatcgcacacctcaccgggatattggaggtatgaatgtgttcgataagatgggcaacattctgccaggttggagaatggaccccaatctgctcatattctcgtgaaaagtttaccagattctcaatccttttcagaaacccgataatggtatcaaaaatccgttctctctcagcaggatcttcaaaatcattcagcagaagcatgtatccccggatggatgttaccacattcattacatcatgacgggttattgactgaagaagccggagttttcgggatatttctgatattttcttctcattaactacgttctctgtgatatccaggcagaatccaaggacctcccccccttcaagcagaatcgcatctgcttcgacatatacaatatttttgttctttccgatcagggttacatttttatgaacatatcccctttcgaagagagtttcaaaaacgatcctggtttctggcacctcttcaggcaatatcagatcaaatacactcatctgagtgatctctgcagatgagtacccggtcagctgctctcctgccgggtttgtgtaggatatgcggccataccgatcaaatattacaacaagatatggagctttttcaaggtataatttaaatttctcttcactttttaagagtgctatctccgcttccttttccctggtaatatcagaaataatccctatgatcttcgatcgcgtatcaggggcagggtcaaagaacccctggatctgaatccagatatacctcccgtttttatgctttatccgatatgagatatcaaactcctctgattcagaaactgccctgctgaatgtatcaaagacattctggtaatcatccggatgaatgatattcatccagagttcctttccatttctgagttcctcaggagcatacccgatcacatggccggcactctcatccatgagaaggatatcattatcaatatcatattcatacgcaatctgtccggtcctggcagttaacttctcataccgctgtttccaggaaagagcctcatttcgcaccctcttcttctcagtaacatcttcaccaatacacatgtacccaaggaaccgccccttctcatcgcgcatgtcagtattgatgatatcaagatcccggatctctcctgacctgaggaggattttcatctcttcatgctgggagatggattcctttgaaacagcctccttatacaggcgttttttcatttcacgaaggtcgggaggtaccgccatctcaaagaagtccttgtggagaaattcatccctggtccacccggtcagagagagcaaatagtcattgcaatattgaactatcccgttttcatccaggtgaaaagccaccatatggattcggtcaagggtctttcgaaaccgtctttcattctcccgtgccagattttctatcgcattcttctcatacagagatcgtatcttgtgaatcagatcggtgaactggccgagaaaatccccacccttttgcagatagtaatccactccattattgatcgcctgaatgaccacctcttccctgcccctcccggtaaagagaatgaatggaagtcttccatatctcttcctcacttccttcaaaagtgaaattccgtccatcaccggcatcagataatcagagacaatgacatcaaataactcatgctcaaggaggtcaagagcggcatgagcggtagaacagaacgtaacagaaagatcggcttctctcttgaaaaatttggagactatgatgtggtaatcagtatcgtcatcaacatagaggatggagatagtcattaaatatagaatgaatggttaatctgatggaccataaaactgatgataagacgaacgggttgcaggtctgggacttctggtgcttgtcaggatatatatcagctgggcttaggcagtcgagattgagaggcgatgaccctggcagccggtatcgtgaaaaaaattacctgataaaggtaaacgctgatttcggctctttacagatcggacatctccaggtcgacggcaggtcttcgaaggatgttccgggagggatgttctgggttggatcgcccttatcaggataataataccatcggcaggggtcacaccgccatattccttcctttttggttgtggtcgatacaacacgcttcatcatatatacataggatttcagaggtaatgacccttcagggagatttttaaggtatcatagaatatgttctttcatgactcgtccggacgcaattacacgggcacagatgccaccatcatccagagaaaatccgctcacaccggtaataatcggaatcattgttgtgatcatattcttggccctgctccttctcttcaccgttgtgatacctcttactgctgaacacggagctgaaaagcgatctgacaggtttgatttcgccgtgaataatgccgtgaaccaggcgatggaaaatgtacatgaaaacgggacgatttttcaaaaagaaccatcagttcccatgagcccgggtctgcttgcaatagaaaagccatttgaggaggagcaggaactgcaagcacagagttgacccaatttatcctttcttttcgtctccggataactgataccagaacagaatatactcttcctgcgtaatgtagcccttctctttgagttcatcaagtttccatgcaagaacgggaggtatcccctgactttttctcttcagttcgacgtttttctgtcgttcccgctcttcaataaatccggttgccataatggcagatggaagtgcaaggacaagaaccccggtcatggtgacgaacccggcaatcaactttccaagcggagtgactggaataatatccccatatccgacggttgtaaccgtcatcaccgcccaccagagggccgcgggaatactggagaatgcatcaggctgggctggatactcgacaacatacatgatggttgaagagaagaggatgataaacaccaggaaaaagagcataatagcaaatatctcttttttccgcactattacccgtctgagctggacaatagattctgagtaccgggtaaaccgtcccagtttgaatattgatgacagacgaaagagtcggatgatcatgatggcttgggggaaaaagaacggaataaatatggggagaatggatatcaggtcaataatcagatataaatggaatgcatacctgacccggtcggtgatcatacggaccggattgtgcgtatcggtgcaggcccacatgcgaagaccatactcacagacgaacactgccatacagatattcatgatgattgtcagaatatcgccatggtgctctgcaatcgggcgaaccgtcgataaaataatggcaatggcatttgcgaggattaccgttgcgagtattccgtggatgacaacggcagtcctgtcatgccatgctggcgtatccaaaatatagtgaatacgggtttttatcgaatttaccttcacatacacccgggggtactcctgaattatatcggctctccccacgttccttcgttaaaagtggagttcccgatccaccgggacgtatttgcgacgagatcaacggcattttccatataagtcaggttctccggtgacgtaaagtctccatggtaatggtacaccttttttacattagtgccatttctgacggtcagtgtggctgttggcatatctgtgatgttcagataggcatatgaatcattcaaatccagaaaaccaccttcgataagccgatcatacaaatcaatgaccagagcaggatcaagagagtcagtccgatttccggcagcctctacatacatctcacccatccaggtgatcgttccattcccaaaaagcgagaccgaatacaccggacaggttccaaaacacatgccacgctcaagagtgatttcaatatcacggaccgcctcctctgatgagaggttagccagcccggaagggaaaagcaagcacacgaacaacacccagaaaagcaccgcaattcgtctgttcatactggtattatgtcatacctggtaaaaaaggtggggaacgggttatactgaataggctgtggcagggatgtcggctgaagggatggcctccgggacagggctggtatatccagatatctcttctaacaagcgatatatctcctcgagttcatctgggtgagagacccctgccttctcatactgggcaatggcagtctcaagtgctgttttcgcatcactgaaccggttcagagagtacagcacccgccctttccctgcataggatgcccagttcgaacctgcgccttttgaataggatattgcctgagtatatgcctctagagccgaaaggtatctcttctggctctcaagggcaagaccagacccataccaggcatcagatgaagaaggctggagctctatggcttttttaaaggcgttatatgccgcacggtagttccctccttcaagagctgcatacccctcagcaacataatcctcaaaacctttcgggacttcagttggaacaggagtataaccataatcgagaacagtgctcatcaggtttggatcaatctgtgcaagcagccagttcggggctgaaaaaagactcccatgcgaccatccgtcggtaccggcgatcataccggacgggacaaccccatcagcatagggataaccggaggagaataccatgcatccggagagagcgagtactgacagaaccagtaccatgattggaactgcagatctcatacatggatgatctcatacgggaaataaatacattctcaggaaaagagggagaactcagagatcaccctgctttttcgagtgcttcctgtgcggcatcagtctcacctagcatctctagtgcctgggcaaggtcacggtacattgaagcaagttcatcaggcatattttctccggactgttcatactggctgatggcaacggtcaaagcatccttcgcgttctcatactggttcagggcaagataggatcttccctttccggcattcggaccccagcttgatgcaggctttttcgagtatgataccgccttcgtataggcatctattgcagagagataccgtttctgattttcaagagcaagacccctgccataccatgcctcggtggatgtcccgtttatttcaagagccttttcaaaggacttgagagcatccttataatttcccccttccaggtacgcccatccttccttgacaaggtccattgcagtcggttgagtcggggtcggctctaccaacttggtcccgaaataatccatcttgctcatctcccgcgattcatcgtcaaactgttccaaaagccagtttggtgcagagaagagactaccatgtgaccatccgtcatctgctgccagcacccctgccggaataagaagcccggtaagaatgagggagatatacaacaccttccgaatcattcctcaaaggttatgaaaaaaagaataaaaacatgtcaggtggttcagatactcatatcctatgaatgatcaccgcgaccgttcttctgttcttcttcgaaccgtttcatctccatctccctgagatcctttcgtttgatcttacctgaaatggtttttggaagttcttttacaaattcaatctttcgtggatatttatagggagccgtgatagacttgacgtactcctgaatctcccgtgccagtttttcagagggttcataaccggctttcagaacgatgaacgctttcacaacaaatccccggatgatatcaggtgacccgacaaccgcagcctcttgcacggcctggtgctcaataattgcactttcaacctcaaatggcccgatacgataccctgacgctttgatgacatcatcatcacggcctacaaaccagaagtacccatcaccatccctgaccgcccggtcaccggtatagtaaaacccgtctctgaatgcatttgcgtttgcttcttcattcccccagtattccatgaagaacccgaccggacggggatcggttttgattgcgatggatccttcttcccctggcttgaccggttttccgtcctcatcatgaagttcgatcacccagcccggagagggttttcccatcgacccgtacttcggttccatgcatgggaatgtcccgacacacaaaaccgtctcggtctgcccatatccttcgtatatttcaaggccggttgcatctttccatgccttaatgacttcagggttgatgagttccccggcacttacacaatgcctgagctcagaaaagtcatacttgcggagatcagccataatcagcatccggtagatggtcggcggtgcacaaaaagtggttatcccgtacttttcaataagcgggagaagttcggttgcattaaacttgttccggtagtcataaacaaagattgcagcaccctcaatccactgtccgaacagtttcccccaagcagattttgcccacccggtatctgaaacggtaaagtgcagatcattattacgcacatcatgccagaaccgggcggtgacgatatgaccaagcggatatgcctgagaatgcagcaccatctttggttcaccggttgtgccggatgagaagaaaataaccatcggatcggtcgcctttgtctttctcatccccttcaggttgataattcgtgaggaaaccggtgcaggataggtcagttcacgcggatatgaaagccatccatcacgtgcaccatccacaaccatctttgtctcaagtgtcgggcaaatactggcaatctcctcaaccttatgggcgttctccatatcggtgatgaccatctttgcctctgacgttttgatccggtatgccagatccttcggggtcagcatggtaggagccgggatgtacactgcaccgatcttgataagggcgattaccatgaaccaccactcaggcactcggtggagcatgataaggacccggtctcccttaccgattttgtacttgatcatcatgttgacgatctcgttagacctgcgtgagatgtcgcggaatgtaaagaacttctcttctccctcctggttggtccagaccattgctaatttgttccggtccttttttgcccacgcatcgacgacatcaaacccgaagttaaaatactccggaacctctatccggaaattccggtaggtttcatcatagttctgcatattatgccggtgcggtgccggggagtcatcaatgatcgggcttgaattcccacacggatatataccatacccggagagctttcgaagctgccgggtacatgcctcattgatccagtcagagcgggaaacctgcctgacaacacattcctgatcaacccgccgggtcagatcatcatccatggtaatagagaaccgaaccatctgtactaatctggtgcaccagattgtaaaagagttgtgaatgggtgaaccagtatttatagaaacttttgcacgtactggagcttccggatatcaggtaccggttgtattcccttcacgcaccatggtgatggccttcttcgggcattcagctgcacagataccacagcctttacagaataccagatcaatctcatattcatcgttaatgaccccgtcaggacagtacatggcacacatcccgcatgcattacatctctccttgtccacaaccggcctgaagactctccaggttccggtattgccacaagcaccctcacgaggccgggatattgcaaggcgctccctcttctccattcagaccaactcctcatacgccatcagggcagctttcaggttccgttcatccgagaacatctctttgattgcagcagcagcagactcccgtgaaaacagacccatctttgcaagggcaccaataaccggcgtgttcaggatggggcttcccgcaacaaccaggtttgtcttcagagcaattccggtcaggtccacataccgaacctgatacccctctgccttcttgggaatatcaggggcattaataaggacctttccatcaggtttcagcccttcaaacacattgaccaggtcaaggatggaaggatcaagaaccacgattaagtcaggattatggatctgcgaatacaccttgatgggcttatcatctatcctgataaatgagacaatcggagcaccacgccgctctgcaccataaaaaggggctgcggttgcaaacttcccatccctgaacgatgctagagccatcagctttgcagcggtgacaccaccctgaccaccacgagaatgaagccgtatctcatacatcaggcatcaactccaaaccagaactcttccccgatacgccgatctctgacaaagcccgcaatatcatgataggttacttcctgcccgccaagacctgcgataacattataacactcctttccggtctttgcacggatagaggtcgccagaattcctccaaacccaaatgaatagttccggtcaataacaaccagttcgcggtcaccaaggttcaattcagggaagggacggatccacctgacccgcatggaacctgcctttaccccttcattccggagaatatccacagcaacttctgcttctttccccagggttcccattgccaggataagaacatctgcatcctcgcaccggtactcctcagtccaggagtacttccgcccgaaggtctgtgcaaatgcctcttcagtctctttgatcacctgaacagaatcccgcattgagcgctcgatatcatacctgatcctgaaataatcagcagatgaagtcatacatccgtaccctgcaggtgcatcagtctgtattgcatgatcaaggaccagcggcggaatgaaatccccgacctcactctcctcaagctgctgtgagatgtgagaaagggcgaatccgtctagatttatcataaccggcaggtagacccttctatcctcagcaatccggaatgccataagcgttgcatcatatgcctcctggactgttgagacatatacctggagccatccggtatcccgtgtctggagagcatccgtatgttcagcccagacattccagccaggcccgagtgcccggttcacatttgccatgacgatcggaagtcttgcaccggcagcccagttgaccatctcatgcatatataaaagcccatgagaactggtggcagtaaaggtcctgaccccggtgatgcttgcaccaatacaggctgccatcgccgagtgttcactctcaaccggaatatatttcgatttgagactgccgtttgtcacataattggcaatctgctcaacaatctcggtctggggggtgatggggtatgctgccacaactgctgggtttgcctgtctgacagctgcggcgaccgcattattcccggtggataccgtcagcatgttccctccgcctctgccttcaaaagacgcagatttcgttcaatctctccgcgaatcaccctgatagcatcttcactaatactggagaaacgcccctgcatcttcagataatcctccagtggtgccggctttatcatagcagcctttgtgggcccactcaaagtcagggaatcgtactcccgttcgtacatggcccatataccggtctttaccgccatctttccgacttcaatcgtctgtgatgcatcataccgccagcctgggggacagggggcaagaatatgcatgaacttggggcccttgatcgacaatgccttctgcactttcttcaccagatcctgagggtaggcactgcatgcggttgccatatagggcagatgatgtgcggcaattatccggtcaagatccttttttacatgggttttcccgccaggagtcgttgttgttcgtgctccgagaggagttgaacctgaccgctgcataccggtgtttccgtatgcctcgttgtcataacagatatagaggaagttggtaccacgctcaagtgctccggacaaggcctgaataccaatatctaccgtcccgccatcacctgcatacgcgatgacattggtggttctccccatagattcaaacgccgcagccattcctgatgcaaccgccgcagccgcagcaaacgccacattatacaccgggatgttaaacgatgtattcggccagaccccctgcagaacactggtgcagcaggcaggaactaccagaacagtatctggtccggccgccttgagcacgtgtctgagaatgagggacgagctgcaccctgcacaggcagacgtacatttccatatatattcgctcgcagaagtccctgacatgacaatctgtacccgtttgtatgcaatgataaataatgatagtttaattgacagggtcatcccacgccctgaaaaaccacaggttaggcacaaaaaaatctgcggcaatgctctggcctggatgaataaatagtgcagcagaacccctcattctcacgaggtctcaaaaaggggcatgaatcaggataccggctcatcgattcacgatcacggaacctgaccagatcatctcccccgatttgtgcaaaaaaccgctcctttgtcagggtgaaatggcagaaatggtgtgactctccaatactccgctcgataaccatataccgcctcatatgcaggcagcatctcccgcactgattacaaggctcagccatttaccccctcatactcagcgtaggcgttaatcgcctcaaggaatagctgcccgtactgcataagcctccgttccccgaccccgtatatcgtccgtaaatcctctggacatctcggccttgccttagccatctcacgcaatgtccggtttggaaagattcggaaggggggcatatccagttcatctgcaatggtctttctgacatcccgtaaaatctcatacaggttgttctctgccggtgatctctgaccgtcatatggctcacctggtaacgcagactgaaattccggctctccaatcctgaccggtatctttcctgcaagggcatcctttgtccgtgggttctttctcaccaccggataccgtgacccgtacctggagaggtacccgcaggcgataagctccctgatccagtacacccacacccctctccggtggggatgcccggacccaaaacaggcaagcgtatcatggccccgtgcgatgaccttctcgtctgctgtcccggagatgatatctgcgagataggagacaccataatcatctttcagttcatcaatacaggctgcaatgaccgcaagggtatccctcccgtccatggtcttccgccctgaatggcatgaatcacagttcccgcatgacggcttatcccatgattcaccaaaatatgtcaggagaacggcacgcctgcaggcacgtgactcacaatacccgaccatctcatgcagcttccggagactgacctgccgttcggtcccttctgccatctgttcaatcaggtactcaatcttgcgaaaatcccctcgtgaatagaggagcagacattctgcaggatcaccatccctcccggcccgtcctgtctcctggtaataatgctcaaggtttttcgggaggtcaaaatgcaccacgaacctgacatcaggcttgttaatccccatcccaaatgctaccgtcgcaacaataatccgaacctcatccctgagaaaccggtcctgggtctcatgtctgaccgactttggcagatcggcatggtagggaagggcggagaacccgtttttctgcagtactctggcaagatcagtaacctgccgttttgaaaagcagtatacaatcccggattcattctgatgactcttcaggaactgaaccagttgctgctcaccgtcttccttctttacaatccggtagatgaggttttcacgattgaatgaaccgacaaaaaccgcagggttatgaaggctgagctcactgatgatatcactcctgaccgatggtgtagcggttgccgtcagtgcaataatcggaacatcggcaaaggttcttctgataattgagagcttccggtattcaggcctgaactcatgcccccactgggagatgcagtgggcttcgtcaatggcaaaaaggctgatcctggtggattttaaaaactcaataaatgacggctgtaccagacgttccggagagatatacagaagcttgagtgagccatcaaggatagatccttcaatgctccgtttatccttcacatcctgggtactgttcagaaatgcggctggaatccccgactctgccagacagtccacctgatctttcataagagcaatcaggggtgatatgacaatcccgaccccgtccctgataagagccggtatctggtaacagagtgactttcccccgccggttgcgatcaccgcaagcacatccctcccttcaagcacatgggtgatgatctccttctgtcctggccgatatgttcggtacccaaaccacctgtgcaggacatcttccggaagaggacctttcatttgcatacaggttatatcggataaaagaaaactgcatcttctcaggccccggatgaggaactcatttcagaaaaaaattcataaaatgagcgaaagattcatgagtatacatcctgaaatgatgacttactcagaagtgccggcatgagtgaggaggtgccggggataagaggataaaaaatgggcacatttcttgttgactatcagaatcaggacacagtttcagataccgaacccgtgattacacaaaaatcaatacaggccgccaggaccgcgacgaaagggagtggaaaccttcaggttgtagaattcattctgggaaatgaactcttcgccatagacctgtttgacacgcgggaagtcatcaatacaaccgaaattacccctcttccaaacactccctcatttatcaaggggatcattgacttacgggggataataaccaccatcatcgatctcaaagatatgatgcatataaccagggaggcggacggaaagaagaggtcacgtatcatcgtccttgatgccggtgtatcagagaagatgatcggggtgctggttgatgatgtactggcagtctcgacctatactcaggatgaaatcgaccaggacacccatgcctcaaaaaggagtgaccgggacatcctgggtattatcaagaaaaaagtccgaactgctgatcatgacaaaaatgaactgataatctggcttgatatcaggaccatgatcgacaaggtcaagcaggatctctaaccctcccggccgggtaaaagaagcgagtaaaccgtccctaaaagatgcagttcttctgactggcgggcaattctttttactttcagccccggagccgggatctcatgccagtcaagatctgcctgcacatcccagaggatgagaccttccggtggtgcaggttttaccttatttttacattcccctttaagatactgcgtgagatccctgatggccatctccccttcagatacctgatataaggatccggccatgcatctgaccatgtgccataaaaaactctgtgccgtgacttcaagccggcatccgttctcatcagatattacttcaatccggtcaatcgtctttaccgggcttttccccggctctatccgtgcaaagcaacgaaaatcatgtgtccccaaaaacaaaccggcagcatctctcatggcgttgatgtctgacggaggcctgctgaaataataccggtaggtacggattatgacatcatacctagggtaaaatgattctggcgcataagcccaggcagacacccagatatcaggaggtaattgtccgttcagagcccgaaccgcgagatcaggattatgggttgagagcgcaagaatctggcattttgcatggacaccgcgatcggtcctgcctgaaagggcaagccttgatacctgacggctggtaattatccctgcccgtaaacaggcagcctctatctctccttccaccgtccgctgatccggctggtattgtgatccaaaaaaagaggtcccgatatacccgatccgaaaggccagtcttacctgtgaagtcttccccggatcttccgccatgagttacgcaatgactgtttggtataaatcctgaccggtgtttttctcccggcaggttttgtctttccttcttgtatggcgttcaatacagacccgatgttcctatcagcatcgatcagggtccgtccatacccgataaaccgggcattatgggcatcactcccggcaacagcgggctttcccatcgtcctggcaagacgcatcgcccgatggtttgcatgagggatgacataccggctgttatacacctcaatagcatcagcggcaccaaatgcctcggcacacttcagtgcggcgccatgccggtaccggtggaacgggtgaggaagaatggtaatcccaccagcctgtctcacttcctgtatggtatcgagaatcggaaatccgggaaggggagctttttcaacaccgagtgcgatcaggtgtccttcccttgttgaaacctccacaccgggtattatcaggatatcggcagatatctcacaggctatccggtacccgtccatcgtatcgtgatctgttattgctataacatccatccctgccgtgacagcagctgcaatcacctgtgcgaccgtgctctctccgtcctttgaacaggaagtatggatatggagatcggctttgagcatccctgactacattatttttttatcttcccggtattaaggaaagggtgatgaggatcctgctgccaaccggaaaagttacgtataccatcgttcaggaagctgcaaaaggctttgacgcggatgtggtggtgaccggtgaactcgcttcatttctgactcctggtcaggtacgctcccttctcagctcagatgcatcctatgatctcgtcctggtgtccgggatgtgtacggcatcatttgcagatgtggaacaggagaccggcattccaatttaccggggacctcgtcatgcagctgatatcggccttgtgctcccgctgattggaaagattgaactctccagggacattcctgccgatgaattcctgtcaggtgaacggagaaaagaggcattagccaggatatcacgaaaagaagcagagagggcgccgacatttgctctgaggggagtaaagatcggcggtgggaccaggataaaagtactggcagagatcatggacgcccatagaacccccgatttacgcacaaaggttctgaaattttttgaagagggggcagatatcgtggatctcggattcgggtttgacgcaacaccggacgatgttcgcgcagtattccgccagcttgagggtattgaagggccgcttgccgtcgatacccaggacccggcacttatcaaagcctcgctcttccgggccgatctcatcctttccctgcaggaagagaacatccctcaggttggagagaaggttgcagaggcaggatgcggagctgttatcgtgcccggtgaggcaggactccttgctaacatccggctggcagaagcatccgggatcaccagagtcattgcagacccggttctccagccctgtggttcaggactggtagagtcgcttgccgggtttaccgatccagagtgccccctcttttttggtgcaggaaatgtcatcgaactctgtgatgcagactcggttggtatgtgtgcccttcttgccggtatggcttatgaaaccggtgcatcagtcatattctgcagtgagcacagcgacaagacaaccggatgtatcgcagagatgcggatcgcaaccgatatgatggctctcatggacggacggccgtacccgaaggatcttggtattgacctgtttcggataaaggaaaagagaagacgaagggaaccgccacttgaatatacagagatgattcaggccagtccgatgccacgggagataacctatgatccccgggggaattaccggattggtatcgaggacggatatattgttgcagtccgaaatggaaaggcaataaaaggtaccaaatggcaggatgtattattcaccattcttcagacagacggagtatcgctctttgaccatgccgggtacctcggtgccgagctgttcaaggcagaacttgcaatcaggttccaaagaagttttgaacaggacgggccgttctgaacacaatagccttgtatcatcagaaccgatgaataggaaggatcattgagaggctacagtgtaaatggaatatttcaataccataagaaattttttccaaaggattttaccctatatcagacggaaaagccgcattaaaacagcgaatatcttcgcaatcaaaaggatccagctggatctcctccttgcaatgggccggggatcacatccccgtgaatttgctgcactcctgtcagcagaatccggaattatttctgacatctatcagataccagggtctatcgggggagaggcaagtgcccaggttccgtttgagatggtccccttgaacctgaatatcgtcggaagcgcccatagccacccgaacggggtattacgcccatcagatgcagatattcgcttcttctcggtcagtggcagccgtcatatcatcgtcggagacccgtatggcccggatgactggcggtgtttttacccggacggaactcctgtcacccttgaggtggtgccatgatccgggttgttgcaaccggaacctttgacatcctccatcccggacatctctggtaccttgaggaatcagcaaaacttggcgatgaactctatgtgatcgttgcccgtgatgcaaatatccgccataaaccaaggccggtcataccagaagagcagcgattggtgatggtagcagccttaaaaccggtcacccatgccgtgttaggggatcttgaagatatgttccgtccaatccgtgagattaaaccagatatcatcacccttggctgtaatcagcactttgacccagaaactctgcaaaaggcactggaaaaacagaacatcagggcacaggttgtcaggatatcagaacattccagttctccttttaccagttcccgggacattgttagaaagattgctgagctgacgcatcaaaggagccagacccgggagacaaaagagcaaagagagtgtggtgccgtatgatccccctgctcgcataccgggataattcatgtgatcccagaaaatgcacgatgaaaaaacttgagcgtgccgggatggtcagactcttctcccgtctttcagccattccacggaccagccttatccttgacccgacggcagaacaggccctctcaccggccgaccgggaaaaaacacgtaccatcaccgctcttgactgttcatgggaggtacttgacacagatcaggtccgttcatggagatttaaacgagccctgccatatctgcttgctgctaatccggtgaatttcggaaggccctttcgtctcacctcaatagaggccatggctgcagcactggtcattctgggagagaaaagtcaggcagaggagattctggcaaaggtcagctggggtatcagatttttacaactgaacgaggaaccgttggctgcatatgcaggagcacaggatagtcaggagatcatcgctattcagggagaattcctctgacagaatttatctactgtgaaaataccatacaaatgaggaactgatggggattcgagactggattgggggacaggacgggagcccggcaacgccatactgtcagaaaggagagacacaacttgtaaaggagaagtatgaagcggcggttcagacatttaaccggggcattgaactggaccggagccatcccggatgctgggtcgggatgggaaaagcatttctcggtctgggcaggtatgaccgtgcggatgactgctttatccgtgccctggatatcgatccggaaaatcctgaagccctgaccatgcgggcatctgtcctccgtctcatcgcccttcagaaccaggatcccatgcggtgcctggaagcagtcgagatatgcaacaagaccctgaagatccatcctgagtacgggccggccctccatgagaaagggatggcgctctggaccctgggaaaacgcgacgaagcaatgagcctgtttgagcaggcgaaaaagatacatgcatcatacccgtacccctgggatctgaaagggcggtacctgttcgaaaagaggcagtaccatgaggcaatcgaggcatatgaagaggcattagagaaaaaaccccaggacccggatctccttttttccatgggccgggctctcatgaagatcggggggtatcattccgccatccagttctttaagaaatgcctcaagattcgtccagattacaccgctgcatggctgctccttggcaactcctacaaggtcttaaaccagtttgatgaggcgatagatgcctacgaagaagcaatggaactggatccgggcagcaccaaatatcgcaagtatatagcagatgtctacctcgtcatgggaaaagaggccctgtataaggaaggaaaacctcaggaggccattgaatactttgataagaccatccggatgatcgcaaaccacataaccgcctggttctcaaagggagtggcctataaaaaactcggggcataccggaatgcaacggcatgttttctcaaagtggtggagatggatccccagaacgggcatgcctactatgagatggcccagatccttgagaagaccgggaataatgaagaagcgatccggtgctaccttgagacgatccggtgtgatccatcccataccgatgccatgtataaggtaggaaacctgctcatggaaggcggggattataaaaatgccatagcctattttgaccgggttcttgataagattcccgagtcttcagtagcctggtttgcaaaaggaaaagcactccaaagacggggacagcaaaaagatgctgaccggtgttttgaacgggcttcaaaactcgccacacggtagatcagatatcaaaaccaagtttattcggtgcaggaacaacctgaggcccgttaaattccggatttccatacagatattcaacgatcagttcggcaaacctttttgcatctcccgggtcacgggcggtcaccaaccggtccaggaagacaaacggcttgtcctcaaacttcacgtccatcttcatcatctccctgataggagctccggatatgaccgttgcaggacgcttttttaatatccctgcccgtgccataaccaccggtgctgtactaatggccccgatgaccttgcggtgaatccgaaagatcttcaccagttcaagaagatccgggttattccagaaatgggcctgggctccatgtccccctaatatggcaagggcgtcaaactcatcctctctggtcaggatgacctcctcaaagcttaagggtacatacacccggccaccaaacgtacccttggcctgccctttttcccgtgacacaaactcgtatggaatcttgttctgatcaaaaaccgccatgacctgtgccagttccttgtcatggtactgggttggggggactgctatcaggattttcatagaaaaaaagatcaggtgctggattctgatgaaccgccactcaggtagtcagccatatctggtgtgatatatccaagttcgcccagaccaaatgttcctttctctacttcaccaaacttcgggaagtcaggaagcgtactgttggtgtaattcgggatgatatcatcaaagtatccgatggctttctcagcctgatcataatacttcttggatttctcataattctcctcgccatttgagacagatgagacataggtccggtcattgatatatgactcataaaagtcccgggcctgtgagatcaggtagaagaatgcatcaatgtaattcgcctttgtatagaagtcttctgcgacattcatgccaatgagatccatatacgtactatctgcccattccagtccttcaccagtcaggaaccgatggcccggtgacttttcagtcttgtcatttgtaggatcatcatcagggagccgtgcccgatcaacataatcctcaaaccagcggatagttgtggtcttgaacttctcggtctggtcatcagcagatgggtcaggagccttctgggtcatcggaatggcaatatccaaaccttcaagggtatcgccctgctgctctgctttttcttcaggcattggttcccctgccggcgggagagtgaacatggtcatattcggatagagatccttgatcttgttccagaactcggcagcgacctgacggtactgatctgcaacggtataatattcagatccatccgttgtctttgagacggattttaaatatgcatggtaatcagtataggtctctcccgccttggaggtatagtagagatatgccgcgatgttatgtgcattggggtagagatccggactgacattctccatgatcagccgataataggcgtcagtcacctcactcaactttgccccggtcgggacagaagagttcgatatctttccgatgatcttttcagcctcgctcttgaatgcttcgtctttataggggttcgcatcagaaggggccttcatactcaggggcatcaattcaaatgtgggtgcaaatccggcgctacagatggatacacagagcaccagtgcagcgatgccggtcaatataagatatacgctgcgtttcataccctcagtcatcatataggcaactcaaaaaggtttcctattgtgatgggaaggactggttgtgctagttgcgcctgacaacagatatagccataccagtctaaccatcagagatacaaggtgggctctgtggctgacgaaaaacaggttgaagcaataaagggaggtgtcgcttcatggaatcagtggaaggcagaaaatccaaggaaaagaccggatctcagaggtgctcatctgacaggcctctccctagatgggatcaacctgaacggggcacgattatctgaaaccgactttgaattttccagcttaagaaaagcgaattttgccggggcagacctcaccagggcaaacctttccaatactgacctgaccgacgcgatattcctgaatgcaaatctgcagggtgcccgacttaccggggcaacggtcaccagggcagatttccggggcgcaaatgttgccggggcagatctcaggcagataaagcgcgggctctgatcaagagacgatagaatacagggtggtccgttctgcaagaaccctgccaaggtccgcacagatatgctccatctcttttggatccaggtattcacccatcccgcctcccgcttccccggtgacatcatccaggtacatcgtcccggcaaggtcatccgcaccggcaagcaaagccatctgtgtcattttcacaccaagtttcggccatgacacctggatatggtcaaagttatccagaaagagccggcagaccgcggtggtcaccagatcatcccgtccggtcggcccggactgcaccaggcctttctcaaacaggggggtcttctgatggatatacgtaagaaggaccatctcggtaaatccaccggtctcatcctgaatcttcctgattcggtccaggtgttctgcacgatcccggggagtctccgtagatccatacataatagttgccgttgaccgaagaccacggccgtgtgcttcccgtgttatccgctcccacacatcggtcttaactttcgccggacatatcgtctttctgacatcatcgaccaggatctcggcagcggtcccctgaagagtgccaagaccccccttcataagacggtcaataacatctgatgtcggaagattctcctttcgtgcgacaaaatccacctcatcaggggagaacgcatgaatatgcaccgatggatagacctcatggacccatctcatgaactgcaagtacgtctccagagtaaaatcaggatgcaccccggagagaaaacagatctcagagactttccgctcttttgccgcccgtacctgctcctttacttcactctcgccaaacaggtatgcccccgggctgttttttgtccggccaaacccgcagaatccacagaggttcttacagatattggtgatatgaatgttctggtttctgacaaaggtcacccggttaccgtttttttgcctgcagagctcatctgctgcacgaaagagatcaaacacctccgggcccgtgactgaaaacaggaatgttgcctcatccggagtgagacgatgaccagcaagggtgtcagataagagggtctgcagatgcatggatcagaccttcctgcccgatttcatctcctcctcccgctttgcccggtttcggagatagagttcatgaaggaccatgataacgaccacaatgatgataaccggaacaatattgaggggaaggtatccgaccaggggaacctgatacatggctttcccgatgatccactccttcttaaccggttcgatgggtcctcccaggttccggtaatttgaccatccgacctgatcgatcaccgggttattatcacctttggtaatatatcctgcatgaggagcggtatacgtccctgttctctggccagcagtaacgacgatctcctcaccctcttctacccagaacatggcacggtgaatgatgggatggagctcggtattgccattcgggcggtaaatgatgacatcgccgggcatcccgaacttctcatatccagaactattcccctcttccatgctttgcagagatccgtaccggtccccggcgaccaccagaaccagatccccgacattcatatgtgggaccatgctctctgactcgatggtcacgatcgccggccaggttccacagatgatgagcagtacggcaaccactgccccgacggttaccagaactgatgcaatctccctgaccgctgacggtatctgctcctcgctcttccagaacctgataattttatcctgtattgatttcttggccttttgatctgccatgatgtctgtatatggtttttgagctggcctcttaagggttcacttcaccggtcaaagtcatgccatcagggctcgcccgtgtgtatgtatatttccctccatgctgaaggtactagtgcagaatgcttgacagctccgttatcgtggaacggtttctggatacaaaacttcaggtccatcctgatgtggtcagatatatctgtgaaaagaaggatgagcggctgattgaccagattatatccggcgttcctgatgactgcctggttgtctccttaaagcatattcccggcattatcccggcccgtgacgggatccggttcctctctgatgcagagatggatatcatctccggacggatggggtccgcacggccggtagcaaaagttgaagattatatcgcatattttgctgaccggtacagccggctctccggtatgatccgggggcggtgcaacccggttccgattgaagccctcaaacgcaacacccggtataagcaggaggagttttcggtctgcgggatggtcatggatgtcaggagcaccggaaacgggcaccggatggtggaactggaggacccgaccggttcggtgaatgtgttatttcataaggaccgtccagactttgcagaagcggaacggatcatccctgatgaggtcatcggggtcagggggtccctctcaaatgagggaaatctcatctttgcagatcagatcttcagacctgacatcccgttctctcatgctccctataccagtgaccgaaaaggtgcggcagttctcatttctgacatccatgtggggagcgatacattcctagaggatgcatggaaccggtttgcagactggctcagtgacagtgaagtctcctacctgttggtcgcaggagatcttgtagatggtattggtatataccctgaccaggacaaggagctggttatcaccaatatttatgagcagtacgatgttctgggagagatgttaaccgatctgccctcccacatcaggattattctctctcctgggaaccatgatgtggtcaggggtgcagagcctcagccggccatccctgaaaagttcagaagtgcatacccgtcttcatgtacctttgttgaaaatccggctctggtgaacctgcagggagttcggtttctcatgtaccatggccggtcatttgatgatctcatcggcctgatgccgggggcaagttatgaaaaggcacatgagatcatcccagagatgctgaagagaaggcatcttgccccctgttatgggcgacggaccccgattgccgcagataccgttgaccggctcatcatcgatcccatccctgaagtggtacataccggtcatgtccatatctatgggatcagcaggtaccggaatgtccttggaataaactcagggacctggcagagtcagaccgcattccagaagcagatgaacatccagccgacacctgcagtcgcaatcgcactggacctgaagacattacaaccgcgactgttcgattttatgaatggctctcctgaaccactcgttttataatcgggggacgataagcctcctgttcctgccggatgtaccacgacagcaggatatcatcaatctcctgctcccaggagatgagatccgaatcgccaggcattaatcggagtgcagcccgtatcgcctttcccgcttcagcataccgcttcagatccatcagaacacgggcatactccttctgcccctccccaaaggcaggatctatccggactgcccgttggtatacgtcctgggcatcggctgttcttccggatttatataggatcatccccaggtgtgccagaacctctgcatcatcgggcatgagggcgtgtgcctttctgcaggctttttctgcatcagcatacctcccctctgcagcaagaatagtgccccaggtatcaagaaagggaccataccccggaacctgcataataaccggttccatgatccgtcgtgcatcagctggtgatccggccatacagagcacatatgcccgggcattatcaagtttcagatcatcggggtactggacctgaaggctgacaatatgattcagggcagcatcaaggttctgcatcctggtatagagaaaggcaagaagaaggctgctgtcatatcctctgacctccggaggtatacttaagaggacagattccgctctctcataatctccccggtttataagacccagggccagtttccggtagagcaggtcctggtgttccatcagagtactggcattgatatcaggaaaggtcccgttctcgaactgatcaagcaccaggatcggatcccgggccaggatcccagtaatattctcctccgcattaaaaagaccggttgccgcgactcccggtgtactccagagcaaggccagaaggatgatgagaatatataaagggctcatgatcagcgatgaaggatctatcaattataccgcgattttctgactggatggatggctcctggttcggatatataaatgccccggtgccaattcgtatcgttatttacgtataatcatcgaatgataacagatcaccgtctcaattcacagtttcgactggacgtgatacgaatggatatgttatatattgtaccggtttgtgcccttatcgggcttatctttgctggtctcagctatgcccggatgaagaaggaatctccgggtgatgaactgatgcagaagatagccgcagccattcatcttggtgcaatgacctacctcaaacggcagtatactgccattgcggtatttgtcgttgtattggcggttattcttacgcttgtaatcaaccccttgactgctatctgttacgtagtcggtgctggtctttctgcacttgcaggatttatcggtatgtactccgcaacaaaggcaaatgtcaggacggcaaatgcagcacggcagggaatggcatcggcctttaaggtctccttctctgcaggtatggtcatgggtctgaccgtggtcggccttggtatgctcggtctttccctgatgttctttgtgctgaccggtatcaccggagccgcggatcttgacactatcagtatcctgtccggattctcccttggtgcatcatcaattgctctgtttgcccgtgtcggtggcggtatctttacgaaggcagccgatgttggtgcagaccttgtcggtaaggttgaggcaggtattcctgaggatgatccccgtaatccggccgttatcgcggacaatgttggtgacaacgtcggtgatatcgccggaatgggtgctgacctctatgagtcatatgttggtgcagttattgcaacgatgcttatcggggcaactgccggtatggcaagccagttccagggcgttccgaccatgaacctgatcgctcttccgatgatgatcgccgctcttggtatcattgcatccgtgattgggtcattctttgtccggaccaacaagaacgaggctcatgcaattcacaaggcattcaactcaggaaccttcgcaggccttctcctgaccgttgttgccgtatacggccttgttcaggtcctggctccagggcagcttggaatcctctatgcaaccgttgcaggtcttgtcggcgggttcctcatcggacttgtgactgagtactacacgtcctatgatcacaagccgacccggtccatagtcaaggcatcagagaccggagcagcaaccgatatcatcgccggtatcgctgtcggtatggagtctaccttcatcccggtcatcatcgtcgccgttgcaattctgattgcaaactactttggcggaatttatggtgtggctcttgccggtgtcggtatgcttgcaacccttggtatcaccctctcagttgatgcatacggaccgattgcagacaatgccggtggtattgcagagatgagccaccagggtcccggagttcgtgccatcaccgatacccttgactctgtcggaaacacaaccgcagcaatcggaaagggatttgcaatcggtggtgcagctctgaccgccctcggtctctttgctgcatacactcaggctgtcaaacttgatatggtcaacatgcttgaaccggtcgtctttgtcggtattcttgtcggtgccatgctcccgttcctgttctcctcctttgccatgaaggccgtcggaagggcagcagggtttatcgtggaggaagtccgccgccagttcaaggagattccaggacttatggaaggaaagactgatcctgactatgcatcctgtatcaccatctctacaaacgcagcacttcgtgagatgatccttccggggatgatggcaattgccgcaccaattatcgtcggtgttgctctcggttcccatgctcttgcaggacttcttgtcggttccatatctgccggtttcctcgttgctatcatgatggcaaacgccgggggagcctgggacaacaccaagaagtacatcgaacagggacactctggaggaaaaggatcttttgctcacaaggcagcggttaccggtgacaccgttggtgacccgttcaaggatacggcaggaccagctctgaacattctgctcaaattaatggcaattgttgcagtggtctttgcacctatcttcatgtaatcctttttttgagatactcgcatatagaagaaatttttaaaaaattacggggttctgatgattccggatacacagcactcatccggctctgcatcaggaataccggactttaaccagcatcgtgctttttcactttgaaacccgggtttcacatacgaatatgccatgcacttctcatcttccctgcaggcgttcgcacaagcctcgggatcaggtgaggaaaggtcaaacacggtataatcttctcccggccgattggtgtctggttccatatcagtcttcgacggagtcagggcgatatcctccggcccgataggaaccatttcgggtatattcatatccatagggtccagggtctgaattgcagcaataaaaggcgttgcaatcatctggatgaccgcaggagagaatgctgcccgtgaacaactgcatttcgcttttccaacaaccggtgaatcatgaggatcactctccccgtcacggtcgagatccagctgggtaatgtatgctccctcaaagcaccaatcctgtttctgatgacttttttcaggaccgacatccatccagtaggttgagccccataatccgtttccggatggctttgagcactgaaccgccccgatgaccggtgaatcaagaggatcgcatccagaacatgagtcaagatctatcccggtgatataggacccctgcgggcaccaggaaccgctcatactatgactagaaaggcctttctgctcaaccggaacccattgactctccgcccatttctcctgctcttttccctctatcctgcagcatcgtgcctggcctataagaggagtatcaaagtcgctgacggattgatcaccatccaggtcaagagcggtcagataactcccgtccgggcagatctggactttttcatggctgttcttaccgcctgtttcaaccggaacccattcacataatctccactttggagtgccgataccaaaaatccagttgtaggcatatgaagtcggacggtaaacgctcacctgattgtcaccccatgatgccacgccaaccacgtgacctgctttattgagaatcggcccgcctgagtcacctggacaggaatataaccggttgttcttaaagctgataccgccccatccgctttcgtctaccggaagagctatcttcatctttccctgtcctggtaatgcgcacttgtctccagtcattccaaatccgacaagtgtgagggtttcaccgacaaggggaatattccagggatcttcaaccggtatgggggttaccagtacctgtgaggatgctggggaattgagttcaagaactccatagtcttcccgttgccatccccgatcttcatactccggaaatattcttacttttccggtgaaggtaacatttctgcggttattgggatctgctactgtccggacattccggaggatgaactgcccctgattcacacaattactctttccattacagaagcaatgtgctgcagaaaggacgagattgtctgcaatgagtgtcccggtacatcctcctgatccaataacctcaccaactgcttcgagttctccatcctgtactgcagtcccgtgtgagagggctgattgcttgatcccgatggctggatcatctgatgatccaaatccaatcaagagcatgaccaataccagaagaaagaggtattttttttcgatatgtttgcttttattcatctatatcatttccattatatccatcaacacacgaacctccaccagttttcctatggatgtcgtactagaaaagatgatgtgtcgtgatcagatttttttaaaaaaaagaattgtttggtggaatttttattaaattgtataaatagagggaatgtgtgcttttgtgttttgaaccccggaccaaaatgacgaatacgtccccatttcagggggaaaaattcttctttcaggctggataattcactatgtctgatgaattcaggagaataccccaaaacagagccctgctgataagaggtaaagatgaatattcacataattcatcatgccttctcatagacttttaatgtcatggatacaaaaaaacacagtcacccgaccattatccatctggtcagcgtacaggtacagggactgttgttcctcttaacggtcagggttatctgatatgatccaggtgcaggaaacgtatgatcaatcagttcgccacttgcagagcccccatcaccaaaggtccaggcacgggtattgggctggggtgatgaatcatccttgaaccggatagtgagcagccctctgacctgggtggtaaatgagaccgtaaatccttctcctggtccacaattgtaacaattctgaaccggtaccggggtcggagttggcgggatggttgtgggctctgtggtaggttctgttgtcggtgtactggtgggttcagatccgatggatcctgccccctcatatgcaatcagttgagaatgagtattatctatgatacggatggctattggaccggaaggaagaggaattgcccctgaaatgagagcaggatcattggcaaggtaatacccgtcagcttttctgaatataatgacccgatctcctggtgaccaggttgtatctgatgagagataggtaggatcggtgatgacgactgaactctcttcactggtatctaccatgaacctgacttcatattgggcatcccgactctggttctcgtaatacatggtatccccattccggtggactacctcaattccatcaatatttggagcaataggtataatttttgcgccggtcaccacataggcggttttctcaactgacgagaccagaccgaagatgagagcatagatgattccggccatagccactaccaggaagatgatcaagatgagtcctaccaacgtgctgaccgctttgttattcaaatcatggggagtcatattagtccctgaattattcatccctgccattggattacgccattatcgggagttattctttattattcggagtatattcacagtttttctgattcaaactggaaagagcacattttctgcagatcggatcaatggatctccggtatcggcaggtgcaggcgagatctgacatggagaattctttattctcaagcagacagatgaaaccgataaccaggagtcctgcacagatgagggcaagtgacgcagccaggatgtgagttattcctccgttcaggacgcagcattcaaataaaacgataagggaggtgaggatgactcctgtgcaggccccaatgtagaggccatggtgcataccaagacgaatagacaggttatcaagggtcatatgatcatatccaatgatgatagataggtacaaggaagagaaataggtattgtattgggtagaaacatggaattcagaatacttcaggataacttcagtaatctcatgaagtgattttcccggttatcgaagatattccaatctaccagattccggggttacttgggcttgatcttgtttttattgccgtatagccagcatattgaaagccacgaactgaaatactgcaatttattgagattttctaattctactcgcatgtagcagttgtaacaggtgtagcacttctatgaaaaagagaccttcacaatttttttggtattggaagcgatctattcattgatcccttcagatccatatacaaccataataaaccacattcggtgagtttgtttatagaatcggttgatatccattcaggtgaatatatgtgatacgttcaattgattgaatgagaatttcaggtggagaaagacaggctcataggtttcattccggtcgaaggattcaaaacatctgctctcttctctgctcggtttaacgacaggtaaaccgaatccagatagaacgcttaaggacccatttcttttacgtaattattcacatgaaagataataatccgaacattaaactgctgtcggaaatggattatcaattcccttttccaggtgcacaggaatcgtccctataacccggccccgaataagggttatttcacatttctacaaacgaatactcttattaactggctctattgttctgatggcagagttggtttctccacatgcattccggatggttaaattgacttcataggcagcagaaagcccaagtggacctaaattttgcgctgttccagttccattcgtccgggatccaaagtcccataccatctcgaccggtacagagggagttccattatcagtcaggtagaatcggacctgatacggattaatgctgatgacttcatattcaaaggaggcatcgggttttgtgcattgtattctggatgaatcagaggggttacgttcatttccaggatctggcattgcagcaggtatctgatgagaagtctggacagccggtgcgggcatgtacggagttatgagaggtgatggttgcattttttgaaggtttgcaggtgcagtggctggtccaggtccgggaaaggtgacgagcagtatcatgaggcacaccatacttgcacatacaataaagattgcgaagagatgtgtggttttcacgcccatccgggtgagatacttcaggagtgatgtatcaagatagaaaaggatgaagatgagtccacataccccgattatatgaagggcggggtagataactgccatatccagaaggaggagtgaagcatacatgatgaggagtatgcaaccgatacacaggcaggcagcattccttataaaacggagaatatcatttcgattaattctgccagttaccgggacaggggactctgttttccggtcatcgtcattcagataggtaaccatcagttcatggaggtttttcagatagatctgattgtcagggtcaaaccggattgcattcagaaaatttgcatgtgcctcgtgatagtcatgcagacggacctgacacattcccagaccattccaggctcttgcgtctgttttgtcataatcgatgagttgtcgaaatttcatggtggcccgttggtaatccccctgatgaaagagtttcatcgcagactcaaacaggtcagtaattatgtctcactcctttcttgttctgaagggttcccctatcagaatgattcatggggatatgtgaaggataagtatttagctgttttgtcggtcaattcgggggatagttatgtatatattgcaggttatttttcaaaaaacagggccggttggagataatcccggtggatatgatgcagggaatggtatcctgtacagagaggatgagtgaggtgacctgtaacagaaggtggtactcatggatgccttaccggaataattcgcaagatatatccgcaattctatcacacaaatcaggactcttggcagagattatcacccgtgatgaccggttccttatgtcccctcaaaacgactttgcatttaaggtgttattcggatcggaagagtcaaaagatctgctctcttctctgctaagttcaattacaggtgtatcatgcacggacatcacgctgaagaacccgttcctcttacggaattatccgctagagaaggagggttttctggatatgaaactgaccacggggaatggagatcagttctttattgagatgcaggcagaacggcaacaggcgactcataatcgaatgctcttttactgggcacggctgcatggatcacaaccgattaaggggaaagattatggatccctgagccggacgactagtatctgtatccttggtcatccttggtttcagggcgatgagccgatattttgttttcatgcattggaaagggagagttttgaacaggtttgtgatgacttttccctcatgtttatgcaggtgggatactctaatagtgataaaggagtttcgtataaaaacgatctctgggcatggagaatatcacggggatcaaaccctgaaactatattctgcacgtccggtataattgccgggctttcattgaatttttgtgcagatcattatatgaaaagtctgaataaacgctctttgccactgagtgtcattccatgacgtgtatgccatgtcctggaaatcgtatcacattccagatactatgattatctaaacctctttcagggcatattgaaggttttcaggcattcaatagaggtttatatacaaggggattgtagtggggcatacagctccaggaatggggatcagaccatcggaataccggggggataatgaaatccggtcagaaaaatttattttcatgtttcaaaatcatggctggatactgtttttcagtaatccaaaccagagggagggaaactgggtggattttttaattctctattctgatgatgaatatgttttattagattatcaccctggaaaacgagaatacgtaaaaaaattgattttaaaggatcttttcatctctcctgaagcggatgtttatatcagaattctataatggaaaagaaccctggaaggtgccaggggatatcagggatattattgccgcaccagaacaggttaagagatttgttccttctgttccgtatctgttgatcgatgaactcaggctgtcagtgcatcatctgctcgaggtcagaaacctctctgcatgtttattcagacttgaacaatccgcagggcctgtggaactcatagagcttggattaagactgaaccagtggatggagacagatgaagggatggctgatatgaggaaggatttctccttgttctttgataatacattaatgagagatcaggatataccgataccaaacccgtttcttggagggaccatgttagctgaaaaagtagacaagtgtattgcagcttataaagcggaaggaaaggaagaaggaaaagcagaagggagagcagaggggaaagctgaaggcagaagagaaggtatggctactatactccgtcggatgaaggaggcagggatgtcaattgttgatattgcacagattaccgggatgccggaagaagtcagacacctgatatagtccaggctcaacagctaacaacttttattctcacctgatattctattatcccggtgcagttattaccccgctaatatcaacccttctcttctgtcggtctggttacatgaagcgatggggggtatcgaaaaaacttttgataagccaggagacaccgatgcactatacttcatttgtttcctgcataacctcttcaaagtatgatcttggatcctgaatgtacatattacagatatctaaccgaagagtatagcttaattcatggagaacatgattcctcactctctctgttctatccattaaaaattatttaattctcatcccgatggattattgaatcagaaagacctacccatttagtatctgatatgaatacttcaatggagagaggttcaatgctccctatgaaacgacaggaaattattataaaactaaaaatggaaatgccagttattcgggagcgatatggtattattaagatggggctttttggctcatttgctcgggatgatgccggaccaatgagtgacatagaccttattgtattatttgaagagggcaaagaacaatttcgtccctttatgcaatgtattttttatttagaacagatttttgggagaagagtagagttgattgctgaacactctcttgacaaaagaattcggcaggatgtactccgtgaggttatctgggtatgaaaagggattctgtgttcattgagcatatccttcatgaaattggatatattgaggagaaatgtcagcaaaaaactcttgatgatttgtattcagatgtggatcttcaacatattgtgtcgcgtgctttggagattatcggtgaagcttcacgaaatgtttccatggcaataaaagacagatatccagatattccatggaaagagatgattggcgtcagggacagaataattcacagttatttttccataaactgggtgatagtatgggatattgtaaccaatgaactctttacactcaagaaccaattagaagatgtcctttctgaaattgaggagtgattccagcctaatgcgactaatcttatgcgaactcgctatatatatctacaattccataatatgggcctagattagggaaccctgaaacggccaaatggtatatggaatcatggtcatagatattttcagaatattattttttattctcacagtgaccagtagttctgtcctatgttcagggtctttctgacatttttcgtcatttcatggagatttttcagatagatctgattatcagggtcaaaccggattgcattcagaaaacttgcatgtgcctcatgatagtcatgcagacggacctgacacattcccagaccattccaggctcttgcgtctgttttgtcataatcgatgaggtgtcgaaatttcagggtggcccgttggtaatcaccctgatgaaagagcttcatcgcagactcaaacaggtcagtaattatgtctcactcctttcttgttctgaaggggtcccctatcagaatgattcatggggatatgtgaaggataagtatttagctgttttgtcggtcaattcgggggatagttatgtatatattgcaggttatttttcaaaaaacagggccggatggagataatcccggtggatatgatgcagggaatggtatccagtacagagaggatgagtgaggggaccagtaacagaaggtggtactcatggatgccttaccggaataattcgcaagatatatccgcaattctatcatacaaatcaggactcatggcagagattatcgcccgtgatgaccggttcctcatgtcccctcaaaacgactttgcattcaaggtgttattcggatcggaagagtcaaaagatctgctctcttctctgctaagttcaattacaggtgtatcatgcacggacatcacgctgaagaacccgttcctcttacggaattatccgctagagaaggagggtattctggatattaaactgaccacggggaatggagatcagttctttattgagatgcaggcagaacggcaacgggcgattcataagcgaatgctcttttactgggcacggctgcatggatcacaaccgataaaagggaacaattctggatccctgagccggacgactagtatctgtatccttggtcatccttggtttcagggcgatgagccggtattttgttttcatgcattggaaagggagtgttttgaacaggtttgtgatgacttttccctcatgtttatgcaggtgggaaactctaatagtgataaaggagtttcgtataaaaacgatctctgggcatggagaatatttctgggagcaaatactgaagaggagatgatcatggcagcacaggcaagtgaagcggtgaatgaggcatataacaggttgatagtaaagagccaggagccggaactgagagagtattatgaagcacgagagatgtggataatagatcaggcaattcgggagaatgaagcgagaaaggaagggagagaggaaggaaaagagggaagaaaggaaacactcaattgagattgttctccatatgaatgaatcaggtatttcgcccgattctattgtatcaatatccggtctgtcaccagaagaagtcaggaagataatttctgattgtcgctcatctcctcggtcataatttcttctgacacccgatgggtaaataatcctgatttatgttctgcagttccggtataggtaccggggtttcattgaatttttgggtagatcattgtatgaaaagtctgaatgaccactctttgccacggaggatcatgtcatgaagtacaggtcgtgtcctggaaatactatcacattccagatataatgtttatttaaacctctttctgggcataatgaaggttttcagggatatcccatatagtttcatattcaaccggattgtggttgcgtatacagttcctggaatggagatcagaccatcagaactctggggtgataatgaaaaccggtcagactaattcaatttcatgtttcaaaaatcagggtcgaattcagtttgtcagtactggagatacgtgggaggtaaccggggtggggttccctgatactctcccctgaagatgtatatgtttgattggattatcacccaagaaagcgataaaaccgtataaattaatttaatcggctcttttcatctctccgaaagtgggatttttttatcggtaatttttttgagggtctcttttccatagaagtgctacaactgttacaactgctacatcgtgccattttgtgattttgtcgaatatatactgatattttattgtttcagataatcagaagacatagattggtcaggggactgatatccatcggtcattatgtgggtgcagggaccggtattcctcctgacgctcagggtaatccggggtgaccctgccatggttattatggatccatgagattttcatgtgtagaattggcaaaacccactctccatcttcatgtagtgaggtttgatgatgcattataactagaaaccagatgggtgatcctctgactagggtagtagattatagcataaacatgatttttttctatgggagcaaaaaattcacggatattgcatcaataccagaataacagaggattatgcataattaaattgacgttttaacacgattaaattctccattcaattgagattaaaagagtttaaaaattttttccccgaaaagtattaattggtttagagttttgtaacagccttaaaaaaattaaaacgttccataccaatccaaataccgatcacatttacttccggggttgaattgaattctccatctccatggtccattgaaatccggattcggatcatcataaagataggaacggattgtttgccacggaggagaattatttccgatatatgcatcatatctttgggctgcatttgcaatgacattcggaataatgtatgagccatctgatgcagtatacgtataccagaggaattcatttggtgttgcattgcggtaaaattctattcttatgttctcaattggcaatccagttgtttcatttctcacaacacccttcaggaagtaacatttaggtccataatatgcaacaatggtgtgatcttcctgaacatttgtaaacacatatggattaattgcacttgaaaatctcccatcaatcaataattcagcaaataaataggtttcttttccgattataaaggatggctccattgaataactctgtgaattgccacactgaaccgaagtaaccccttccggatcgatcatgccggtaattggtattggtgtgtaactacccacatcaagatatactgccgaagctgtgatattatacggccctcttggcacaaacgatgcactgatattatgtggttcagtcacattcgtaaacgtataacttctgattggacccatcgaagtcccgtcaacccgaacgtcagaaatattccaacacgtgagattggtaatgctaaaagattgatcatatccacaattgaccatgactatcccatttggtgtaatattcccaccaaaaccggcagtcgcatttattggaaatgtcttcagagcaaacactgcatgaattgattgatctgaagttacattcgtaaatgtataggtaaagggacttacctgaggaccaaggtgctgtgtcccgttgatgattacatcggtgatattaaagcagaatgccgctgtaatagtataactctgatctgaaccacaatcaaccacagttattcccagtggatcaatcgttcctcccgcatctgcagatgaggcgatctggaactgttttagatcaaagtatgcatcaatggtctgatcgtactgcacattgatgaaggtgtaactctcaaccggtccaagatgcagtgcattcggttgattctcatcaattaccacatctctgatcgtatgacagagatccggcgtaatattgaactgctggctccattcacaggggacggtgacattccctgacggattgataaacccaccctcatgagctgtggcaacaatagttagcggcaggcatccaatcggcagatacatggaattcgtagattcacttccacatgagttcttaatggtaaggattacctggtagtcatcacggatgtaataggtatggaccgggtgctgctcttttgaggaggatccatcgccaaagtaccagttccactctactatgtcatatccggtggagagatcggtaaactgaacagtcaggggatcctcattaacaatggtataattgaataatgcttcaaccggcgggcaatagacatgtatctgttcactatgggtttcattccctccacacgggctggttgcatggagtgttgctgaataattcccacctgttttgtaggtatagactgggtttctgaatgaagagacgcctccatcaccaaaggtccatccccaggattgcggcgttccaattgtcctgtcagtaaagtatacagtcaggggagcggtgccatttacaggttccattctataggtgaaattggcatataccgggcaacaaacgagtttgtcaaatgtgtccctagctccgcattcgtttgttactgtgagtgaaaccagatactctccacatccagctgcgtaggtatggtcagggggattctgtccagtgtaataagttccatcaccaaaactccagttccaatgggtgatcgtttccggtttttgggatgaatcgcgaattctgacagtaaagggttcaccggagattatctcggttgagaagttcgcaactggcggggtgcagaagcagggggtggatatgctctcccgatagctgttcttcgctccgcatgtggtagtaacagagagatttacctgccatgttccgtttcttatgtatgtatgctgtgggttttgaaggatagatgaatttccatctccaaactcccataaccagtcagagatatcatctccggatgtctttgtggtgtcagagaagtccaccgtcaatccatcaggattacaggcataggtaaatccgggaaccggcatctcacaacaggggacggtgacgaatctggtccatctggctgatgagttacatgttgtaaagaccgtgagatttaccggatatgtgccgggattatcatatttatggttcgggttttgtaatccggaggtgttatccggccttagatctccaaactcccaataccaggcattaattccaccgccaatcgcacgggagaggtcggtgaagctgacgtttgtcggcccggtacaggtgtagtcaaagtcaggttttggtggtggacagccacagatcgcgtcctgaatgacatcgtctgatgaaccacaatcggttgtgaccttcaggcggacggtgaactgaccacaggctgcataccggtgagtcggggtctgctctgttgaattcgtgccatctccgaactcccataatactgcagtgattggccgttcagaaacggattcattgatgaacctgaattcctgtggatcggttgttggttcaatacggaatctcgcttctgggagtggacaaccacagatagcatcctgaatgacatcgtctatggagccacagtcggtcgtaaccttcaggcggaccgtgaaatggctacaggttgaataccggtgagtcgggttttcctcggttgagtttgttccatcaccaaactcccaaaataatccggtgatcggacgggtagataacgactcattgatgaaacggaactctaatggatcagcagtggtctcgatcctgaattgtgcttcaggagctggacaaccacagatagcatcctgaatgacatcgtctgaggagccacagtcggtcgtaaccttcaggcggatcgtgaaatggccacaggttgcataccggtgagtcggggtctgctctgttgaatttgtgccatctccgaattcccagaataatccagtgattggatgttcagaaacggattcattgatgaacctgaattcctgaggatcggttgttggttcaatgcggaatctcgcttctgggagtggacaaccacatacagccggctttactacctcatcccaagaaccacaatcggtcatgactttgagacgtactggatgctgaccgcaggttgcatactccttatcaggcgggttctttcctgaataagatgttccgtcaccaaagtcccagagatagttcgcagctaaaccagttggtatgatactggtatcagtaaaacggaacgttcggggattagcaattacattggtgattgtgaaatttgcgtcaggttgtgggcaggtgagagagatatccctgatcgtatcaccaaagcaaccatcctgatcccatacccgcagctttaccgtataattgccatatgttgcgtattcgtgggtcacgttttgggtgatatatcgggtgccatctcccatatcccactgccatcgctgaatggttccctcgggtttggaggtatctgtatacttcacagtttttccggttggtacataaacaaaactggcgttcggtattccagggatacagatgtctccaccgcaggtagctttgcggatggtgtcatcccagcatccctgcgtatcaaataccgtcaggagtatggaatactctccgcatcgtggatatgaataggtaaaggtcccaggagggcttgtattattgaaaactactccatctcccatatcccagatccattgcacgagacctgttgatgactttgaatgggtggaattgtcggttatggagataacaaaaggagttccaatctgttcttttgctactgaaaagttggcaatcgggttttcatagcagatacacggtaaggacactgtttttgttgcggagtaactgccacaatccttcgtatttaccgtcagagttgcgctgtaatctttacattgattataatgagaataaccatgttggattgagccagtccaatcaagatgagaaatttgagtcctatttccatcgccaaaatcccagatgagtacatagggtttgccaaacagataggtcccagcgttccataagaaattcacatcccaagtatctggagatctcccttcatatatccaattaaaatctgcattcgctgaacaattaatggaaacctgtttggttgtgctgcaatatatacggtttccacactggtttttcccaatggtcagagtgactctgtacgacggaatcgttaaagatgaatattcatgaattgggtttgattcagattttgtgtggccatcgccaaagttccatcgccattcatcagctccttctgaccgatctctaaaactaatattgaaccgattatacggatcactttcataaatgaaattcgcataacaagtatcagaacagccatacactgttactgattgcgaagatgattttgagcagacaggatagtaactatccttctgaataactgtgtgaataacctgatatgtcctgtctgttgtcagattcgggaatgtaatcgacgcatctcttccattcattgttttggaaaaaccttgccccaatattgtgtatgaatgtgtgccatttcccaaactcgaaagaaggtaggtaggaggattggatcctgtatgagtgatagaaaagagagcatctgattcggtgagcgtacaattcacatctggatacggagtaggagtcggcgttgttggaatggggagaatagttgttgcaccaggtttcccgaattcacgatagagatgttctccacctgacttattgagaaggatttgatatgacagatttgttccgcttgcaggaacacgtagactatatccaaacccaagatctgaacctgatgtgctccaatttgtagcatttccatcaggtctgattaagtgtatcgtatgctgatcatattcttttttaaaggttccattaaaaacacgtattctgatcgagtctggtgagaggttatctcccccgctatgagtaaaaaaggcatatccagagctgttcgtatattcaatctcggtatgagggagggttgtcttcggatactgaccggttgagtaagagagtattataccggttgcaataacaagaaccacaatcagagataacgacgatactatctcggatagagcatcttcacaataccttttctttacatggcctgatcgtttccgaaaaataatatctccccccatcttctcatcctgaaaatataaattcatgaataaagccggtatgatgaagcacgaccgtcaaagtagatatttccaggctcgagtgacaactccatgatcttatccgtagacggcattaattccgaaatttcaaggttctgataattctggaccgatattgggacaccattccagactaaattaatccaggcattggtctgtcggtatgcagtaattttgagatttgagtgataattctcgaaatcatttatttttatcgcactgcaaacaccagtatctacagggttcccattaatggagagtattacactggtaacattgaatgcatttatctctcccactattctgatatttgcacgagtctgggcaactccaatatccaacctgacccggtctccattattgagtgtgtactccgttccattcacggtaattgtagatccgcttcctctgacgagccagcttgcataccctggatgcaggtacccgttcctgtttgtcagaaggctgacggtgtttaatactccagtggtattaatgtatttactgatggtgcttgactgacctgtgacatttgttacctgtagggagactgaataattaccaggattttggaagatatgaattgggttttgtagagtggatgtatatccgtcattaaagttccaggtccatgacgcagggccgccagtggaggtatcggtaaaggaaacctcgagaggtgcaggcccttcccagggatcagcagtaaagtttgccagtatgggctcttcgcttcccactcttaaccatactggacttgaatcacgaaatgttccttttcctgggagaggataagcccgtgttaccacagagatggtctttccggcatatgattcaacattcacctgtaggttaaacctattattcagtgcatcaaagaccatctggccagcattctgatcatcgatcaataaccatacatcactcgtattacggttttttccacctactgtcgcagtaaaagtcgtcaatccctttaccacagaattatttaccggtgatataataacaggcgtaacaggctcaaaatcaacagagacatttcgataggtggtaactgtagctccattcgtgagaagatttctcgctacgagagtaatgtactgaccctcccatttcgtattattccaataaccggtattatacccaagatatccaatataaggaagattcacaatcatcccatctggaagatggagtttacaattcgtatttccattcgcctgattctcatttggcccgacataatggacttcaacatatgaactcgtattataaggaataagctcattctctcgtgggtagtaaaattcaaaaaatgtcgaatagttacggagatagaagagatcaatatctgaatatcgatatatcgtgttatccggtactgaacaattaaatcccgtgttaaatacggagccatttgctctccaatgccacgtggttagccaataccatgcagatcccgttttataataaaggttgtaaaatccaggatgcaaaataaaactactatccccccaattttcatatcgaatataggggataaatgccccattacccgttccatcctgtggccatgacttcataggtgttgaatcaaatgatgttgtataatcaaatggccaatttttcggataattaccccgtgatcccggatagctggacccatatctccatcgtgacggaatctgtatctcagaaactctccattgtgcatttccaaaatgaacctcattgtattgccgttgtgtggagattaccagggccgatgagtacgtttctgcccctgaaccataggaatacgttactttccagttagcaggtaacacttcacgtattctgaacgttccataggtcacatcaggaagattaaatgtataatctccatttatatctgtagaatttgactgccgatctacccaatttcctgccacccgctcttgtagataaacctgccagttcgaaagcccctgttcttcaggatcccggacaccgttcaaattcttatcattccagagatacccactgatacttgcagggtttgtgacattcaccgtttttaccgtgctatacggattaccacactcgttcttaacctgaagtgtcacataatacgtcccaatcttggaataggtatggtttggcgggtttctggagggggggctggtcgtataataactggttccatctccaaagaaccaaagccagctcatgatcttatccattggtgttgagttgtccgtgaacttcacctcaagaggactcattccggacgaaggagtgagattaaaatctgcggtcaggttcgggcagtcaaaggcaatacgccgccatatctgtgcagtattaccacaactattctttacaatcagaccaacgttgtaattctctcttccggcatagaggtggtagggatgctgctcttttgatgtcgtcccgtcaccaaagaaccaggtccagtctacaatctcaccaccataggagagatccctgaatgagacattgaacggatcctctgagatgatggtataactaaagtctgcaacgacttccggacatccaaaggttaagattttactatgtgtttcattcccgccacagggactggttgcatggagagtgacggtgtaattccctccttcattgtagatatgtaccgggttttggagatatgacgttttcccgtctccaaagtcccagtgccatgcattcggctctccctctgtcagatcagtgaaataggccgttaccggagcatctccgtcagggggatccagctggtaggtaaagtttgcaaataccgggcagcatacgagctgatccacgtcatcgtactgaccacagtcattcgttacccggagatttaccagatactcaccacaggaattataggtcttttccgggggattctgaccggagtaagttgtaccatcaccaaatgaccagttccatgatgtgattgaattgctgttcggaaccgactgatcggtaaatctcatggtgaagggctttgaggagaccatctccttcgtgaagttagcaattggcggggaacagagacaggggacggtaatattatgaatccatgagttttgagcaccacatgtcgtcgttatggtgaggttaaccaggtaggttcctggctggttgtaccgatagacggggttcttgtctgacgatatgcccgcattatcaccaaagtcccatctccaacgggttattgcatctccgaataccttcgaggtatcattgaactggatggtattcccatcctcaagacaggtgtaggtaaagtcaggaactggcatctggcagcaggggacggttacctctcgtgtccaccgggctgatgaattgcaggtggtgaataccgttaaattgaccggataggtccccggattgtcatactcatgcgttgggttttgtagtccggatatattgtcttgcctcaaatctccaaactcccagtaccaagccctaattccattgcccattcctctggataggtcggtaaagttgacagttcgttctccaatgcatttgtaatcaaagtcaggaaccgggggcggacatccacagacgatatcctgtatggtgtcattactacttccacaatcagcggtcaccttcagtcggactgtatattggctgcaacttgggtaggtgtgggtcgggttctgctctgttgaggttgtaccatctccaaactcccacaaccacgatagattcacatgaggaacatgggtggaacgatctatgaacacaaactcctgaggattggccgaagtagtatactcaaaggctgctttcggggacggacagccgcatatgacattctgaatcgtctcattactactcccgcaatcagccgtcaccttcagtcgaactgtatattggctgcaacttgggtatatgtgagtggggttctgctccgttgaggttgtaccatctccaaactcccacagccacgatagattcacagaaggatcatgggtggaacgatctatgaacacaaattcctgaggatttgccgaagtagtatactcaaaggctgctttcggggacggacagccgcatatgacattctgaatcgtctcattactactcccgcaatcagccgtcaccttcagtcgaactgtatattggctgcaacttgggaaggtgtgggtggggttctgctctgttgagtttgtgccatctccaaactcccacaaccatgatatattcacaaacggttcatgggtagaacgatcggtgaacacaaactgctggggattggttgtattattatactcaaaggctgctttcggggacggacagccagttgtgatatcctggaaggtgtgatcccatgatccacaattcgttgttactcgtaacctgaccgtgtaggttcctggactagtataccgatgagtaacgctggagcctgtcgaagtaacaccatcaccaaagtcccattcccagtctgtgattgtgactgaaggatcatgggttgatgtactggtgaacctgaactcacgggggttggacatagattcgacggtgaattgtgcaatcggttttgggcaattacaagagacttccttaatgacgtcatcccagcagccgatatcatcccataccctgagttttaccgggaatgagccacatttgtcatactcaatccagaatgttcctggtggagaggtatttatcgcagatgtcccatcaccaaagtcccattcccaacgggtcagcgtgttattgtttgaataagacgagtcaatgaagttgaaccgtttcgggttatttggagcggcagttgcagaaaattcagcccgtatatcgtcgggttcacaattacctccaccgcacgagatggtccgggtagtttcagcccagcatcccatagcatcatggacgatgagtttgatgacataacttccacatgatgaataggtatgtgtaaatatgaaaggatctggttttgtcgtggtgttgaaatttatgggtgtcgtgccatctccaaagtcatatgtccattgaataatgtccgatggtgtagaggtatcattgatgatcgtggtcgtattatttgactttatttctgtggcagtaaataccggagttgggttttcttcttctgtgcagatacaggggagattaactgtttttgtacaggtgtagtagataccaccatggagatcgatgacatccatttttacactgtaatcgcgacactcggtgtaagaatgagagatccgattagaatctggccatttagttattcctgcaaatccgtcttttgaataggtttctgagttactgccatcaccaaagtcaaactttactttccagtccttgttatccagacctttacatacatctggatgattccatgtaaattcaacattccatgggtttcgtgtggatggatcatagttatctatgaaacacccgcacacaatcgattctgttgtgaccttctgtgtcaccgaacaggtgaaatcctggtcacatcgatttatctttttcgttaatgttaccgaatgaattgatttattatccaggtaggtgtgctctacttttgtattatttattatcgttttattttgcccatctccatattcccaagaaaaaaaccccttatctgggccatcagcggtaaattgaacagttttcccatcaacaagataactaaacccggcaacacagggggcatgtgaacagggagggacagttacatactgaatagaagaatcactgcagatgggggttgaattatacaccgtatgctgaatgaaataaccctgactgtttgtatcgtagggaatagggagggtataatcaaaactccattctttagttgaaatagatactggtagaaaatttttacctgatattgtccatttgtgagttagattatctgcatgagcggatgcaatacaggtaagattatttcgataatcgccgacagtatctgcagtaaacgctgcagatggggtatcattacaaaagccaggaatgggaacaatggttggaactgccgtaacgtttgggatttcaatcggtctgctgtgtccagttccgaactcttttatcaggtaattccctgtagatacattatggtgtatctgatatccatcattaatttcagtaatatttacaaccgatgaataattccattccaggtcaggatgatctttccacctgacttcataatccttttctcctgacgtgacattccacttaacaagatagacattattcagatctattgggtttcctttctcatctgtaaatgtggttgcgtaaaacctcagtgaatcgccaccaccatggtaaaaagatgcatttgcacctgatgtatcttcatctttgggtatcatctgcacggatactttcgggatatcctccggtggcgggcctgatgtcaacatcactgacacgatggatatacctatgataacaagactgatgaggaggatcgctgcaacgacttccgagacagctctatctttagaattcattgttttacccatatacccgagagtcaattttcatttcgaccaatgcatggttgagagtaaggtgaagattgtaattatttttaggtgtcacattaacattaacggtttttccatgctgtcctgattctacagttaatccatcactttttagtaaactatcgatagattttttatagtatctcgcttcatcttcatcagaagcggttatctgtatcaaaaacccttttgcattttcaataatcccttctttcaacttataccagttatccccactgttgatgatattgtgtcttactccttttagagtcgaggtaatctgaacctcatcatgaccgccgaccaatgcatctccaaagagagagatgaggttgatatgaacattacagatatttcctgcaggagatacctggatccagttggaagatatttttggttggatgattccattctgcttaagttgcacctctccacattggtaaatatattcctgattgatccaataggggttttgtgatgaataattaaatgtcccaataggtgttgtgtccatagtgatatttgccgtaatataatcaagatcaccagtgctcgaactattaccataataggtgatatactcgaatagatcacttggattttttggaattaggggaggggaaccatcacttcgggtatatacataacttaaatttgatctgatcaactgatcgttcgatagtccgtatgcctcttccatgagattaactcggatagtttcattccaggtatatggtgacacaagcccccgatagatgacctcatcttcaatggttttcattccattctttatcacagagagcgttacttcttttaccggataattgagaatttcaaggtgtgagacctccctggtttcaggatgttctgtccagtttaatacatgatacagatcctcctggcggagtgtggcgttctttacttcaaggactgccacccagtcaacaagttcccatggattaatcaatctacttgaggtgatatttgttggataaattgtaagagtatggggatcaaagggaggcatttgatttggataaatatttgttgagtaatttacaaaaatcgcagaataatcctctttaatatcacctgcatctgaaccggtaatatttatgaaggtgccattgattattgtcaaactcaaattaggcatttgagttattgcaacttttccgctggatgccaccggttgcatcactgggaaaatgctgaatgcccctcctgatgtttgtcctccagttccaagagaaagttgctgattgaatgatacaccctcttggttgttataccatagcgaatcgatattcatcttgaaatcggtaaaaaatttctcgacgttttgcatatgctggatctctgcatccctcccctgtgaaggaaccacataggtcatatagagagatccaagaataacaatgatagcgataattaagataaacccgatgacctctgataacccgtcatccgtaacccgaccagacatgactcctgcaggagttatctaccggtcaccagatatacatttcatatggttaacccacaccggatataggctgcccacaaaaaaccggtgattatcacgtatcacgacctgcaaatcaccgaacctctccgaaaagagggaagaagcatacacaaaatcgaaacttcgcgatagatggggcttttaggactattcaggcaggtaatttcggctcatgaaccggacctgggaacgatggaattggtgtttattgagggcaggagaggtccaatacgatagattccggggagtgaacgaatccagagcggagggaatgggtgggagatagtaattgaaaaacaggggggcgggttttcatagggaaccggagtttatcgttgggaatggaaaataggagaggagggttattgggtcgggagggagagggattttttgagtttatcgatgattgattgatcaagaccggttgctttcttgataaactcatcgtccataccaagggagaggaggtttttcacgaacccttctctttcttcttcccttccttcttcccttcctttcttcatcccctcttccagtccctcctctttcgcttcatacatacgtgtagcctgatcatgaagaaacatctctcttgcttcatagagccgtcgggtctcttcatcaagactcataatctgaagattgttatatgctttttgtattgcgggtttgccttcagctgccataattatctcctcctccgtatatgcatttaaaaatgtaagccacgataggagatctgtacctttatatggtaccctgcacctatgaacctttgggagctccagaaaatgaatttcaaagacatcactcatgaggatatcatgggttttatcatatgcctgaaagcaggtatgaagatcttctacaggcatcagcatataatccaggatatttatcacgatggtgcgtttcagctcatgataactatgacctctattgagttggtcaagatacatttttgcccagtagaagagactccgtttctccattgattttagatcgagcacctgcatctcaatgtcaacataaactccggaatctgataataccttgatgtccagaatgcactcctttttcgtatcaggtatgagcagatgtggatcggtgcacacaacactctgaaaatgatccggaaggatagcattcagaagatcaaggaggatgtcagagttattcggatctccaaagagtaaccggaaagcaaaatcattccggggggacatgaggaattcgccggtatatgtcgttattgatctcatgatggaataattcgccttcatgaattgggcttcattttatacatgagttgctctttctgatggtgaataaaagaaaaccgcattacggtagattttcttaaaaggaagggagacgagattagagtgagaataaatatcgggatgacctctgataacccgtcatcgaaagcccgacccgatatctattgcggataattttgggcacctgatatacatttcatatggttaacccaacccggatataggctgcccacaaaaaaccagtgattatcacatatctcgaccttcaattcgttgaacctctccaaaaagaggaaagaagcatacacaaaaatcgaaacttcgcgatagatggggctttcagagttattcagagaggagagttcggctcatgaaccggacctggacccaatggggttggtgttgatagagggcaggagatgtccaaaacgattgattccggggggtgaacgaatcccaaacggagggaatgggtgggagataggaattgaaaaacagggggtcgggtattcatagggaaccggagtttatcgctgatgtggaaatacgaaaagagaggaggggttattgggtcggcagggagagggattttttgagtttatcgatgattgattgatcaagaccggttgctttgattatcagttcatcctctatacccagggagagcatgtttttggcgacggtttctctctcctgtttttttcctttttccatacctttttttatacctttttctaagcctttctctaagcctttttccattcccttctcttcagcatactttacaactttaaacatacgtaattcctcccataattcatcaagtattttttggtcaacaatcttatccgctaatattaaggttaattcccggactttatttcgaagatccttttctggaagttctttttcaaggtcaatcgttctcctgagcagttcaatttttgtgagtttgctcttcataagaggtaaaaagataagttccagttcgtttaccggttcacctttttccagagcagcccgcatctgggagagcagggcatcaccatcacgatcagacagaacgatttgtagtacgttatactgtagactgccaatatctaatacttttgttccgctcgaactatcagcaggagtaaggactaccgtatggaccggggcatcataatatcggaaaagacggagatcataatgagcaaacctgatgagatctctttttgaaagattcatttcctcttcaaggtgaaggatagatccatcctcaagacgaaagttcagatccatcatgtcatcagttgtctcaacttcagggatctccgtcaccaggaatgagattattggtggtagatcaatacccagaaatgccagtgatctattgtcaaaaatcgagaaggcttctttgaaaaccagatcgtaattttttttgcttatctttctcatgtgggggtaaaaactctggtgcgaataagattagaattattcggttttatgttggagaatgcactaccgggggaacatctccgatgcaggaagaaagagaatgaaatgaagagatggcctctgataacccgtcatcgaaaacccgaccagatatctcttgtggataattttgggcaccagatatacatttcatatggttaacccaacccggatataggctgcccacaaaaaacctgtgattatcacatatcacgacctccaaaaccccgaacccctctaaaaagaggaaagaagcatacacaaaatcgaaacttcgcgatagatggggcttttaggactattcaggcaggtaatttcggctcatgaaccggacctgtactctatggagttggtgcagataccgggcagcagatgttgaatacgattgatttgggggggtgaacgaatccagagcggagggggggttatcagggatcctgaaaaacagggagaggagaggttattgggtcgggagggagagggattttttaagtttatcgatgattgactggtccagtccggttgtttccattacgaactcatcatccatgcccttggaaaggaggttttttgctacttcttttctttcttcctcccttcccttcttcatgccctcttccagtccctcctctttcgcttcatacatacgtgtagcctgatcatgaagaaacatctctcttgcttcatagagccgtcgggtctcttcatcaaggctcataatctgaagattattatacgctttttgtattgcgggtttgccttcagtcaccataattatctcctcctccgtatatgcatttaaaaatgtaagccacgataggagatctgtaccttcatatggtaccctgcacctatgaacctttgggagctcaaggaaatgaatttcaaagacgtcactcatgaggatatcatgggttttgtcatatgcctgaaagcaggtatgaagatcttcaacaggcatcagcatataatccaggatatttatcacgatggtgcgtttttccattgattttagatcgagcacctgcatctcaatatcaacatgaactttggaatctgctaatgccttgatgtccaggatgcactccttttttgtatcaggtaagagcagatgtggatcggtgcacacaccactctgaaaatgatccggaaggatagcattcagaagatcaaggaggatgtcagagttattcggatctccaaagagtaaccggaaagtaaaatcatatcggggtgacatgaggaattcgccggaatatgtaatgatctcattgaaataccgaatcggtcatagatgggaacagggaatatttatctccctgaaggagagagttcagacaatcgtaggaaggtgacctgatggctgataacaagaaatcccctgaaactggcgggataaccatgcagatacccggcaaagggagaacaaaccgtgactggtggccggaccagctgaacctgaagatcctctcccagaactctccactctctaatccacttggccagaaattcaattatcgcgtagaatttagtaagttggaccttgcagcggtgaaacaagacctgagggatctgatgaccagttcccaggattggtggccggctgactttgggcattacgggcctttgtttatccgaatggcatggcatagtgccggtacttaccggacctttgatggccggggtggcgctagtggcggagaacagcggtttcccccgctcaacagctggccggacaatgtgaatctagacaaagccagacgccttctttggccgataaagcagaaatatggtcagaagatctcatgggcagaccttatgattcttgccggaaatgtcgcccttgagtcgatgggatttaaaacattcggctttggaggaggacgtgaggatgtctgggaacctcaggaagatacatactggggatctgaagatacgtggcttggagataagcggtattcaggggaccgtgaacttgaaaagcctctggctgccgttcagatggggcttatttatgtcaaccctgaaggtccggatggcaacccggatcctgttgcagcagctagggatatccgtgaggttttcgcccggatggccatgaatgatgaagagacggttgcactcatcgccggtggccatgcctttggaaaaacccatggtgccggtcctgcatctcatctgggacctgaaccagaagctgccggaattgaggagcaggggcttggatggaagaatagttttggtaccgggaagggaaacgacaccatcacgagtggcattgagatcacctggactcccacaccaacgaaatggagtaataatttcttcagggttctctttagttacgaatgggagttgacaaagagcccggccggagcatatcagtggaaaccaaagggagaggcaggagccgggactgttcctgatccccatgacccgaagaaacgacatgctccgggaatgctgacgaccgatctggctctcaggtttgatcccatatatgagaagatatcaagacgattttacgagaacccggagttatttgcagatgcttttgcccgggcctggttcaaactgacacaccgggatatgggcccgaagacccgatatcttggcccggaggtcccggatgaagatctcatttggcaggatcccatcccggcaatcaaccacccgctgattgatgaccaggatatcgctcttctcaagagcaggattcttgcatcaggtctttctatctcccggctggtatataccgcctgggccgctgcatcgacgttccgtggatctgataaacgcggaggtgcaaacggtgcacgaatcaggcttgatccacagaagaactgggaagtgaacgaacctgaagaattggcaaacgtgctgaagatactcgaggggatccagcatgaatttaaccagaatgctcccggcggaaagagagtctctcttgctgatctcatcgttctgggaggctgtgctggtattgagcaggctgcaaagaatgccggatattctgttacagttccattcactcccggacggatggatgccgtgcaggaacagaccgatgcagcatcatttgctgtgcttgaaccgatggcagacgggttcaggaactatgcaaaacgtcatcttcccatgaaacccgaggccatgctgatcgacaaagcccagctgctgatgcttactgctccggagatgaccgtgcttattggaggtatgcgggttttgaataccaatttcgggcagacaaaacacggggtttttaccgataagcctgaaactctgacgaatgattatttcgtacatctccttgatatgggaacggaatggactccggtttcagagacagaagacctctatgaaggacgggaccgcagaaccggagaaattaggtggaccggaacacgagtcgatctcatctttggatcgaactcccagcttcgggctcttgctgaggtatatgcatgttcagatggaaaagataagtttattcaggactttgttgcggcatgggccaaggtgatgaacctggatcggtttgatcgtattcaatgatcaccaccaccatgagaatgatggtggatcactatccaatatcttccaagttcatattaaaatgaaaagctgggaacagatgaaaggggatcccggaagcccctggaagtagctcaaactctccatgatgttggatatatcgaagatgtcccgggtatggaaacaaaggcaaggcagaccgggaaccatgtgatcatggtgaaacatggcttggatgtcacgctgtccatcacctgctatcgcttggcgagcctgaactcgtcagaccttaagaaagtgaatatgagcacttaaaaaatctttttctacctgaaaatgatgaatattcaaaccatcagaccggagaaagaggtatatgcggggaaagggagtcgaacccctgaactcctacgagaaacgctcttgaggcgttcgcctttgaccacttggctatccccgcacaataagaagaagagatggtatggaagagatccacaccaagctgacgtacttaggttggtgaggatcctatttgtatatttttgatatgatttcacatccggacacccacatataaaccttctataaattactgaccggtcatcatagatcgatacttactttagtccacacataataggttcaagagaatggacaggtcccccaccatccacacaatactccggcttttcgcactgctggtcatggctcttcttctttcaaaaagcattggagccgcatccaatcaggacaacgggcagttcatcctggtcctgcattcctataacccaactctgacctggacggcaaatatatcccagggtatcctggcaggaatggggccattgccggcaaatacctccatctcatttgaatacctgaactggaagaactacccaactgaagagaacctgaaccttgtcgaagaccttctacgataccgatacaaaaacctaccggtggatctcctcataaccaccgacgatgccgcactcatctttgggctgaagcaccgtaccgaaatcttttcagatgcaccgataatcttcaccgcgctgaatggatttgatgagatacggccagacacatacccaaaaactaccggtgttatcgaagcaataaacccggaagataccattgacagcattttccgcctttttccagatacaaagcatatcctggtactctgtgaatatacagaatccggaaaaggaattgcagagatcatcaggaaagccagccgaaactatcagaatcgggcagtgttcacctacatcggtgatatcacaaccggggaagtatatgaggagatccgaaaccagacaccaggaacggccatcctgattggttcatggtcggtggataaaaccggtgccatcgtagacatcggtcagtttgcagagaaagtagcagcaataagcccggttccggttttcaacctctatgattttaataccggacggggaaccgttggagggagtatcctttccggatacaggcagggatatattgccggtcagatggcctcggagatactgtcaggaaaagagatatctcaaattccgattgtgggaactgatgcaacccagttgatatttgattatgccgttctggaacgatttaaggtgccaaaggagcgtatccctccgggaagcatcctcctgcatacgccaccggcattcattgagcagtattacgggtttatcatggctgccctgcttgttatcataatcctggctgctgctcttattaccctcctttccattatgcttgttcggagaagaactgaaaagttaatgatgacccttcttgatgcacttcccggatatgcttttttgaaagacaggaatggagtataccagtatgcaaaccagaccttgtgtgatacgataggtctgagggcagatgagataaagggaaagaccgattatgacctgttccctcatgaaatcgcaaccagataccaggagcaggatgacactgtcattgcatcaggaaagccgctctttatcccggaagagactatccctgaaaaatctggaacaaagataccgctcaccgtgagaaaagtgcctattaccgatgcaaaaggatctgtcaccggagtaatcgggcttgcatttgacatcaccgagcagaaggcagcacgggaagaacttctggagagccacgagaaatactataacctctttgaacttggaaaagaggcaattttcctcattgatcaaagcaccggagagatactagaagcaaacctctttgccgtcgagatgtatggataccagaagagtgaactcatcgggatgaatatcacctcattatctgcagagccagatactaccagaatactttcatcagaagtccggaccggaacatttgccattcccctgcgatatcatcagaaaaaatcaggcgtacggtttccagtggagattatcggccgggtctttgattggaaaggaaagatatggattgttgctgccattcgggatatatcagaacggctgcggactgagaatgcaatcagaaaagccacggagaaactcaatctcttcaattatctcacccgcaccaccatgaacaaccagctcttcattcttcgggggtatcttgactttgctgctgatatcgtccgggattctgatgctgaaaaataccttgaacggagccggagtgctgtccgatccatcgaccgtctcgtcctcttcatgaaaaattaccaggatatgggattaaaaccggcagtctggcagaatgttgaggaagtattcatctatgccatatctcacctgagtatgggaggaattaccagggagattttcgtgaaagggctcttcatctatgctgatccattcctggaaaaggtgtttctgcaccttgtcgaaaactccatcacacatggtgaacgggtaacaataatcggcatcaggacagaacaggacggagaggatctgctgctcatatacgaagataacgggattggggttccttcagactacaaggagcagatcttatccctgaaccttgaaggaaaagcaggaatagggctcatactggtcagggagatcctcgcaataaccggaatttccataaccgaaacaggagagtatggaaccggtgccaggtttgtgatgcgggttcccaaaggaaattaccggtttgagagcggcattacatgaaatctgcaaggcccatctgttcaaccttttcttctccgaatgtggactcgatattcatgtctattacttctatccgctgacgggtatattcggtaatattgtactcttcacatatctgcctggacatctgcagatatttcttcaccgacccttcatgcacagttggaataatatttccgccgcatttgcattttccggcaagaggcatccggcggtaactggtattacacttggtgcaccggaatttctgttttgaaaaggcagagaggtttccctgcagatcgcgaataaaatgggtcttcaggacacgttctgcaacatcgtgttcatctacggctcgaatccgctttgcaagggagagttcacagtcaagcttgtccagcatcgactgaagctgggtatacatcgtctccagggggccggcagaaatatctgatgtgtcatgagtaaagaagaatccctcgatctgtgcaggagtattcagccggcgctcaacccggtcaaccagactctccacatccttggcattcccgtaccggagagcggtctcatacacctcaatcgggtacgtcgcacagacatccagattatgactctccttgtcaatctcagtcggatcaattctgctcgtcaggaccagaggagcatccatcgagccaccccgtgttaccgggagaaatgaacgggagaagttaatcagaccatccagcagcagcatgacacagtcctcatcaccgtcacactggccggtgaagatcccgtttccaactacattatgatccctatcaaccgtaaggcagtacacccgctcatcctcacagggaacataatcgatggatacaatccggtcactgattaccacgccagattcccatacaggaactgcatcgcctattttcacctcaagagcccttattttccgtaaatatgagacgtcccagacaagcatggcatggtcaggggttaccaggagattctttccccgtgaggttgagaactgaatcaggtttgctggtgccttgtgcacggagaccgatgttatctttcggagatgcgggattccaccagtgtcaacacttctgacatgggccggccgaaccgggtcggcatagaatgtccccagagcgtccactccagcctgtgagagatccaagtgttccagaacaaaacgtctgatcggaatctcctccaggatcccgtccgcataaatctcgataagggtgtctccatgaaaacagttcctccgtttcgcagcatggaagaacggatgtccatatcccacatttgcttttgaaaatccgatgatccgggcaaggacaccggcactggtgtggggagcaagaccgatgaccaggtggccgacgagatcactccgcgtttcaaggttgtaaaagggaggaaggccatagaccttctcgagcagtgtgtcaataaaccgggtgcaggagaagaggtagtccccacagccctccggtacaagaatatcctgggggggcagttcaagaacctggtcaggattctgcaggggaactccatatatatcctgcagataccctaattcccgcagtctctcaaccgaaacaccaatctctctgggcctgaagtgggtgagcggcatatcaatgatatcaaacctgactgtcccgtctttgaagacaaagagcttgtttgcagcccggatcacccctttttctatgagctcgaccggcttattacgtgatacaagtcctttgacacctttcaccagttcaacatcccgatcccgcatgccaaggtcagcaaaagcctgctgcaacatctgccggacattgacggtgtactgcctgactgatgtgggctccatgccacactgggggcataccggtccctggacctcaattccgcatcgtgaacatgacaagaccggttcagtatgggttccacatgagcaccggtttttgtatgactcagtcccacaggcaggacatcgcctgacacccatctcaagctgcaggttccccccttcggtatttgcctggtaggagaatttggaggcttcctgcactgaccgccgggaccctcctgcttccccgaccggaaagagtacatggggggcaggtttcatctcccggggctttgatttccctggtcttcccattcgtcccccgatcctggtccctgcctttgatctcatcttcattccggagagaaactgcacgagatccaacgcggactcagggagttccttctcccaggaatcggagagagcaagggagctgtcaagccccagacatttgagaactatcctgcatggggtgatacggatcataccttccctcacctggtgttcacagagcacacgctccagatactcctttatcgtgggatcaagcgggagaatgagggttttatcagcgagcgtgccatgcttgtgaataaactcagcaaggctcctaatctcggcaggtttgagatcatcccagaggtagaggtaatcaggatggaggtataatccggactcacattggagaatagcctcatcttcatctgccggacgggtggtgcctccttcaagacgccaccaggactcacagtacgcagacgggacaagcacatgattgttctccatgaactcgccataactgatgagtatttcaccaacatcgatgatatgactgacctgggatgagagttccctggctcgttttgcatcatggatcctgaccacatcaccattgatgagtctgaccgtcgggccctgaatgctgtcaaccggggagattccggcagcttttcccggcctttctatcttcatctgggttccgacggcgagaaaatccccaagaatatgcagggttgcaggattcagacccgctgcagcaaggccggtattccgtgagcggccatataccagcctgaatcccccctcccgcatcgggtatgaaaagacgggtcttcctccgattaaatccctgagaaatttatctttcgggtgaatgcccacctccttttcttctgatgatgagcttccggcagtggcctggatcatctcttcaagccagtcccagccgtccatcttcatttttctgacgttttttaggacttttggtgcttttaaggcaagaccttcggcgatgacaagggccattcctccccggacggtgtttgtctcaacccgttccagattccgatgacctgatacctcttccttttcagtcggttcaccatcaatacagactggacagttactgatgataagccggatctcgcgttcggatgggagatactgcagactcatgatggagttatactgcctgatctcctcgatataccgttcaatctcctcttcccgtggcatgtatcgtgacatgcccagaattctccggacataatcaccgaccaggacggaaagagcctgtgccgttcctccggcactccggatgggacctgcatagtaaatagcaaggtattcagatccgtcatcatttttcttcaccgcaaccttggcaattccttctatgggtgcagaaacgaccccttcggtgaggagagccatggcagtccggattgcatgatccaggatctcttcttttgtcgtctctccaaacttcttttctgcaaaataatcgccaatatgaagggacgcctcttctcgggacatgaccgcttcaagttcacggatcatctgggccacaccggggatacccacctgggcctcaacccggtctgccagatcatttgcaattgggatctcgacaaccgtctcagggtcgagtccagtcttcctggcggtcttcgcaacctccatcgcctgtgcaagacctgcattcagccggtcataatattcctgcatccggggtgatatgtctgccatgatgagatgtgagtattatgtttgtcgtatgagtggataatgtgctgattctctgaaaaaaacgggagtgatgagattcatgctcccttcagtccgcctttcaaccgggcctgatcaaggagggtctgaatggcagaatcacctggtcgcatctccaatgatttcttcagatagggaactgattcttctgttcttccaagggcaaagagtgatttgccaatccctgacagaacctgaacatcttcagggaaagaaggatatgcctggttgaatgatcggatcgcggactgataataaggttcagcctgggtcccgaatcctctgtcagacaactcctcggccttccttatctctgcaagacccttggcccgccaggcatctgaaaacccggggagcctttcgaccgcactcccataactctcaatcgctttctgatactcctcttcattcatccaccggttcccggcctcaaatagtgatctcgcttcagatgctgctattccgttcatccagggaaggaggaagagctggaccagaatgataatggccataaacagggttgcataaaagagaacaacctgcaggattcgggggatagatgatctccgggctttaggggtttcctgatcaggtgatgagcggggcggatgataggactggtgaagatgggcatagtaccaggtccggggatcccggtaccgcctccctccgctgtaataccgcccatagtctgatccttccgcttccaggagggagatatcatatgcttcccgtttcttctgatcttttaagacctggtacgcctcattcacgaccttgaataactcttcagcctctggactaccgcatacatcaggatgaagcacctttgccagctttctatacgatgccgtaatctcttcgggtgaggcatcccgcctgacatttaatagctcgtaatatgactccccgggatcaggcatcagttgcttctcagtatcaggatacaactacgttaaactatcctgccatccatgatcatcatcactcaggggtgcaggctacccggatacaatcctccgttgacccgatgacagccccggctccacacatggtcggaacataggagagtgccttcccgctgtttaccatgatccgatcataccgttcaagggctggggagacgaccatacaggtatcggcatacactctggctccggaacgctctatccttctgatctgctcactctcacgttcgatgacatcccgtgcagcaaagatgtataccggttttgtaaccgaacatccttccaggagggatgcaaggtatatgagttcatcaggagagcaatgcggacatccgatagccactgcatccacctgctcgccggtaaagagggatgccacctcatcagcgttgatgacgaactgctctagcccttcggtactataggagaagacccgtgcttcaggggtgataccctgcacatgatacagggcaacagccccggttgccgccatcgctgccccgagatttttcagctgatccctgcccggtcggattcctgaaaagagtggaatccgattcccgctgattttaccggccagatacccgagtgccccgtaccaggatgcatcggcttgctttggttcaccttcaacctgaatatgaataccgggttttctgttctccaccaggtgaagtccgtattttggtgttttcccgattatcgctgctgcaagagctgacgggccaccctcccggttggttctggcaccgatgaccgagtttgcataactgaccgctgaggactctgaccatgccagatggtccccatactcggtgatgttcaggtagtacggagtacatgtgcattcaagcctgatgccaagacgctcataggctgagatgacctcaagttgtttttttgcaaatccgggatctattcccatctcctcccacctgatccgatccatcccgaccgggttgaggactgccggaaccgcagcatgggcatcaagacttgccagccatttcagcccccattcaccgatggtcttgtatgacgctccggagacctgggcactcctgatcggtaccatctcctcagcaccaaagacctttccgactccgaccaggatctccaggagctgctgttttgtctccccttcctctccattgagaatggcctcttcctctgcagtcaggtgcatatgatcagtcctcccagaccgctctgacaaactcctcttcctttcctaactccatggttgcatcaatacccatcttgacattgagcccgtccccgatcctggatggatcaagcgatgaaccacggacaccgggaataatgagggtgtcacggtctgcacgaacccgtgttgcaatggcaaactctacgtcagatggattgccgggattgatatcaccatcaacaatgaccacatgcttaagtgacgtatgtgcagcaaatgcagccatgatggcatttttcccatctccctcggttcgttttttaatctggacaacgccatgcaggtacccgcatccgcccttggtcaggaccacatcggtaaccccggtcactccggcaactgaccggtagatgagcggctcatagggtgctcccatcaggagtttatgctcatcccctgcatttacaagtccgtggtagataaagtcaggtttcgtatacatcccggtcagctcaatcaccggttgtacccgttcaggatcataggtcctggtgatatccacatatgggccttcaacagccgtctcatttccaatgtacccttcaaggatgatctcagcgtcaggaaccctgaccccgttcgaaagggtatataccggcatctcaccaccaaggagttcagcggcaaagggcagttccatgctctccgggactctgctgcaactggcaaagaggacaagcgggtgcataccgatgacgattgcaaccgggagtcgctctccattggccagggctttcttatgaagggtatgcgtatgtctgccttccaccagacgggcaacaagtctgtcttttcccgctttgagcatccggtgaacagaggcattctcaaccccttcgtaccgggagaacactacacccgagtttaaatatctcccggcctctccgggataattttccatgatgggaatttcatcaaggtttaccggcctcatgggaagggatcctgcatcgaggagttttccgtcataccggcaggaagcaagccggggaaccagaatttcgggagcaacaccgagggccacagccagggattccctggttgcgacaaggttcataaccgcttttctgccatcaagattatgaaagaacaaaagccggtctgtactgaatgcacgctttggtgcgtcatatcgtgaggaaaccggatcatgcacatcagtgacaagacccctggttctcatctgttcaataaatgtcctcatggatatccactccatcttccgcctattgagtgtgtgatattcagatgatccagtatccgtgcaataaccgcatccacaagcccggtgatatcatcaggccggtgataaaagggagggctcgccgtcatgatgagtgctccggcatcatgggcacgaagcatattttcaatatgaatacgtgagagggggttttcacgaaggagcagaatacagggtcttcgttcctttaatgtcacatccgcagctctggtcagcagatttggcgtaaagccatgagcgactgcagacagggtcttcatgctacagggtgcaatgaccataccctgatgaagaaatgagccactcgcaaccggagatgcaagattatcaggcgaatgaacaataagatcagaatcctcaaaggatacctgttcatgacgggcaatctcacacgccaccggagtcagaatgatatgaacctcagcctttccagccaggtggtcaagcagccttctggcatagagcatccctgatgctcccgataccccaacaattatcctcggattcataattcacacctcatattcgctcctgtattaacactctgctgcgggacggataccggtatcagtcatgtgattcacagagctatctttctctgaaccataatgatggtatcactctcgagaaatgattgactcggttgatacgtttcgcgcacaaaagataattaagacccactcatagaaatctggcgcgctcaggatttatcggatccaatatattgatataaatccttattaacagaattaggtcttgttttccggtcaggggcatttccagagccgggtttgaaaatgatagtatttaatagagctaagcgtacagattagcacatatatcatgtgaagggtatcacctgaatcaattcgggtctacctgcggatgggaggcgtaatgatgaagatgtggagatatgtaccaattattctgcttattctcctctgtggtggggtcactgcacaggagattgtgttttctcctacagggggaacaggagaagagatccaggcggggaatatatcattcagtaccccggtgagtgcatcaagcggtattgcaattctttcggttgcacaaaaccctgatgagtataccatctcgaataccgtgacggtagatactaccagatttgatctctcctcagagtcatgcgggggagctgagaagcagatcacgttcggaaacctgaaccatattaacccgaaagtttctgatggaagagttgtttttgaagaatggaatgcaggtgtttccggcattggtctgtatgatatacagtcaggtgggctgtatccggtatatccggggaaacttcatcagaccaacccggatatctctggcagaatcgtcgtctatgaacaggccggagcaggatcaaaccaggtaaccaacatcaacgggtatgatctgcagaccgacactgcagcgccaatctcttcatcaacttccaaccagaaccagccggtggtatctggacgatatatcgcatggcaggactggagaagtggcaatcctgatatctacatggctgacctgaattcaggaaccagccaggcggtaacaaaggatcttgcagaacagaagagacctgacatctccggatcatatattatctgggaagactggcggaacggtaatgccgacatttatctgtatgacattaccgccgggaaggagtaccagctgacaaatgaccgatctgatcagagaaacccacggattagcgggaagattgttgtctgggaagataaccggaatggaatttctgatatctatgccatgacgctggataccttccaggagtaccaactgaccgatagtaagtataaggcagtaaatcctgatgtttctggtccgcttgtggtgtgggaggattaccggaacggaaacgcagatatctacctgcttgaccttattaccgggtatatctaccaggtaacaaccaaccagggagaccagaagaatccgtcgatctatggaaatcatctggtctggcaggattaccggactggaaactcgaacatattcctgtataccttctcacagggagtcggatctgggaagtatcagctctatggctctgccacgataagcggaaatgcagcaccggtcgggactgaagtcaaggctctgattgacggggtggtcagggcaaagaccacggtgcagcaggctggaagttatggatcctcctacggaccgttccttgagattccgattaccagtgcagatacaggcaaaaccatctcattcagactgaacgagttccaggcagatcaggtccttaccgtcggcacgggcggagttatgaggcaggatctctctgcttcatcggttccacccgtccagacatataccctctccgggaatgcattcgtaaacagcatgcccgcaccggttggaacaatcattaccgcaaccatcgattcccagatcaggggacaggttacggttaccaccgcggggtcctataccggccttgcaatcccggtcaatcagaacgactctggaaagacgatcatctttacggcaacaaccagcagttcatctctgcaggcttcccagagtattagcgtcggacaacaggtaggtggctggtttgacctgacctttggaacaactccctcgccgactacctaccagttcagcgggtcagttctgcttgacgggcagtatgcaccagcaggaacagtcctttccgcagtcattgacaatcagatcagggggcagacaaccgttacgacaaacgggcagtacggcaccctgaacgttccggtgtaccagaccgataatgggaaatatataacctttaccgctcagttcagcggggctacctatgttgccggacaacaggtgacggtctcggtcccgcagggcgatctcatcatcgcatccgcagatgtctcttccgcaagtggtcagattattcagaagagacttgacctgaccttcattgtgtctgcccagtccagatattcattctggggccgggcaacccttgacggaacacctcttgctgcaggaaataccatctacgccactatagacaatcagattcggggacagataactacccagatcgccggttcatacggctctgaaaacggaccataccttgaagtgccgatcaccaatgccgacattggaaagaccatcagattccagacagcaaccggggcagagggagaccagagtcagctggttgtaagtggtctgaaagtcttaaagaacattaacttcgtctcaaaaccttccagtgctgctgatttcacggcaactccgacccagggggctattcccctttccgtcaagttcacagacaagtcatcaggaaacccgaaatcctggtactgggacttcggcgatggaacaacctcttctgaaagaaacccgacccatgtatataccagaaacggggtctattctgtcggtctgatgacaaccctgtggaacgggcagacaaagagcgttgtaaaacagaaccttattaccgccggaatagtcagcccgccagaggcacaggtcaccctgaaccaggggtggaacttcatctctgtaccaaagatgcttgcagatggacaaaactccgccaaagccctctttggtcatgttgatgtcggcggtcacagtatctttgcatataatccacggacaaaatcctggagcaccgtcagtgctaatacggttatcaatcctcttgatgcggtctggatttactcaaccaagaaagatgcaatatacctctactttgccggtgacgctcttcagatcccaccgaccagaaaactggtcaaaggatggaataccttcggagtaaccagcctgaatacggttcctgcacagaatgccctgctttcagtcagagaccagtggatctatgtaatcggctttgactcctcgatccagcggtatcagggcaccatcatgaacgtgccggagagtaatgccaatgttctgtatcccggatatggatactggatttatatgagtgaagagggagatcttgccgctatcggcatataaggagaatgtatcaccaatttttgtacaatatgagaggaaaaaccatgaaaatcgcatcactgttaatggttctgatgttcctcctgcttgtgccctgccttgcagaagaggagatcgttgaatttgagcctgttgtaagtttctcagcagaagaattgattgcgcaggcaccaggtattgaagaacagatgacctttgactcagtctttgactgggacccacgggttgacgaacagtatgttacctggacacaatacgaaggacagggaaaggtctggtactatgatatgaagtccggaaaccgacagatggtcgctaatattatgagcgatcagaataatccggacatctccggaggtattattgtttgggatgataaccggcacaagaactctgacatctactcatataacataccgatgcacaaggaaagcccggtgtatgtggatactaccaataagttcagaccggctgtctcccaggatatggttgtgtttgaggactttggcaatgatgatatcagggatatcgggatggtaaaggtaggtaccagtgccaggccggtatacatcaatccaaatgacaaagataaggccaaccctgacatcgatggcgactggattgtctatcagcagcttgatgacaacaaaaacgactggaacatttacctctataattataagaccgataaaacagttcaggtgacaagagatctccgtatccagcagaatccacgaatctccggtgattacgtcgtctgggaggacaaccggaacggaaaatgggacatcttcatgtataacatcaaaaaggacatgacaaccgctgtcacctttgatgattatgatgatgtagagcctgccgtatcaggatccaagatcgtgtggaccaggtatgatcaggagaataacagcgatatctacatggtaaacctccagatcccgaagacctatgcggtttgtgtcggtcctggaaaccagatacgtcctgatatctatggtgataaggttgtttggcaggatgaccggtttggcggatgggatatcttcatttacacccttgaaccggataccccctttactccataccagttctatggcccggtcaccttcaattacctccctgctccggtaggaacagagatcatcgcaaagattgacgaggtaaccaaggactccatcgtcacgacccaggagggatattatggtggagcaggaggttttgcagatcagctgacggtaaagattaaccaggctgatatcggtcggcagatctcattctggagtggaggaatccagggagcaccatcggttaccgtctccggtgacgggaagatgatggagcagccgctgaattttatctatgcacagccgcttccggaccttctgttctacggttcggttaccattgatggtcagcctgctgcgaagggaacagtcctgaaagcaatgattgacggtgttgtcagaggcagttatgaaataacccagaccggtcagtatggtggagaatatgaaaccgatccggctctgcgggtcccgattactgttgatgacatcggaaagcacatcaccttcatggagggggagtatgctgcaggtcagactttccagataaccagtgggggcagattcagacaggatcttacctttaccacgattccgccaatgagtccgtatgaattctacggatatgtccagattgacggtaagtcagccccggtgggaaccaccatacaggcaaagatcgataataccgtcgtgaccacctatgtcaccaggtatgcaggttcgtacggggctccggggcaggctcctgacgatccacgactgatcgttccggtcactgaagctgatgcaggaaagacgatctcattctggatcggaaccatcagggcaggggcaacccaagtcatcacccgtggcggggagcgtatcatccgaaaagacctggactttggcagctcaccacaacctggtattaatgcagactttaccgcttctccacgaagcggtcctgctcccctgactgttcagtttactgatctctcaacaggcgggccgaccatgtggttctgggactttggtgatggagtcattccggcaaatgcaacctgctcaggaactgactgtcacaatatagcaaacccgattcacacctatgcacgggaaggcacctataccgtcactttgatagcatccaaccagtacggagcatctgatactgaagtaaagaccggatatatcaccgttggacagattacaccgggcatacaggcggactttaccgcatccccacggagcggttcaaaacccctgacggtccagtttaccgatctctcaaccggtgggccgacgatgtgggcatggaactttggagacggaacgactgaaggtctcctggcaaatccgacccatacctacgtaaatgacgggacatacaccgtcacgctgactgcatcaaatcagttcggagcatcagacacggaagtaaagtcaggatacatctgtgttggaggcagtccacaaccggttgattcaatcacgatttatccaggctggaactttatatctgttccaaagaaactggcaccaggaaaggatactgcagcaatcttcagccatattcaggtggacgggcacagtatcttccagtatgatgcagtgaccgggcagtggataaccatgacctcatcaagcccaataaagccactcgatgcagtctggatctactcacgggtcgcagacaaggtctcacttacctatgactctgatccgctgcagacacctccgaccaaggagttacgaaagggttggaatgcaatcggatttaccggacttgaaccattggaagcaaagttcaccttcctgtcagttcaggataagtgggtaaactgccttggattcaacgaagagaaacaacagtatgatcagatgatcatcaagggcaggaatgatgatgcacgcctgtatccatacagcgggtactggttgttcatgtctgataacggcactcttgccgctatttcagcctgattattttttggggatgataaaaatgtggggggatgtgatatgcgaacagagacaggattcagatggataccattaagttggtatgagataaggtacggtttgagtgggtgtgtcagaggcacatttcacaactgctggtggtgggaagaatgaaaaaaatagtgtatatgctcgccctgtttctggtgctgacatttgcggcatcaggtatcgtgtcaggagcaggagagcagactagtaaagcaggagctggagaggccatctgtgatggtcctggtggtgcctgcattattgctgattttatcgggagccctacagacggggtcgctccacttcgtgttcagttccttgattcatcgaccgggtatccgacgatgtggaactgggactttggagacggaaatgttgcatccggaactgcaaatccggtccatatttacagtgagcccgggatttataccgtcagtctgacggcgaccagtattaccggtgctacgagtaccaaagtcaggcagcggtatatcattgtcagggataaatatccgcttgaggcagatttcctggcaaatccaacctatgggaaagcgccacttcatgttcagtttaccgactgttccaaaggtgctgttgaagagtggagatgggactttggagacgggggtactgcatatgagcagaatccaagtcatatctatcaacggcctggcaaatacaccgttacactgacggtgagcagcccgactgcagggacaagtaccaaggtgaaggagaagtacatcatcgttgagccttcctgtatcatagaggccaggttcagagctgatccaacgtccggttctgctccgctcacggtgaagtttacagatctctcagttggaggaccaaccatgtgggcatgggactttggggatggaaccaccgacatggttgcaaacccgacccatgtgtataagaaccccggaatataccaggttcgtcttaccgcttcaagccagacctgtgaaccaggagtcagtgaaacgaccattaaggtgaatccgccgcagattaaggcagacttctctgcaaacccacggtctggtgaagctccgctgacagttcagttcactgatctctcgaccgggaacccgaccatgtggaactgggactttggggatggcacaatcataccagccagtgaagacgaggaagtggcctgtgaagggggaagatgtccgccgccgaacacgcttcagaacccacggcatacctacctggtacccggaacatatgccgtgacactgaccgcttcaaaccagtacagttctgatacggtcacaaagacccagtttgtcacggtcacaccacgggcaatcaaggcagacttctctgcagacccacggtctggagatgcaccattgacagtccggttcaccgatctctcaaccgggaacccgaccatgtgggcatgggactttggagacggggcaacagacatggttgcaaacccgacccatgtgtacacaacaccgggaacctactcggtaacgctcaccgcgtcgaaccagtatacgtccgacaccgtgtgcaagacacagtgggttaccgtcagggatgtgtcaatcaatgctgactttgtcggtaatccgaccagcggctatgcacctctgaccgttcagttcaccgatctttcaaccggaaacccgaccaagtggctctgggacttcggggatgggggaattattccggcaagtgaagatgaggaagtaacttgtgaaggaggaaggtgtccgccgccaaacaccctgcagaatccacggcacacctaccggctccccggcacgtataccgttacactgacggtatcaaaccagtatggcacctctgacacagaggtaaagcaggcatacatcacggtcaccgcaaatgcaatcgttgcagactttgatggaaccccacgatcaggatgtgccccgcttaccgtccagttcaccgacaagtcatcagattcaccaaccatgtggaattgggacttcggagacggaggcatcattccagccagtacagaagagaatgtaacctgcgaaggaggagcatgtccgccgccaaacaccctgcagaacccgagacatacctacaccgttccaggaacctacaccgtcaccctgaccgcttcaaaccagtatggagcaactggtacggtcacaaaacaggcatttatcacggtggagagttgtccggcaatcaaggcagactttgatggagtaccacggtctggtgaggccccgctctcggtcagctttaccgatcgctcgagcggaaacccgaccatgtgggcatgggactttggagacggggcaacggacatgattgcaaatcctgtccatacctataccagggaaggaaagtacaccgtcaccctgaccgcatccagcacatatggatctgacacgatctcaaaatctgagttcatcaccgtgaacactccctatgatgatctcatcccggtatcgggtggttggaacttcatatcagtgccgaagaaactggcacccggatttgacacagcatcgatcttcaaggtcattgactcaggcgggcacagtatgttccagtatgacaccggaaagcatctgtggcacacccttgatccgtccagcccgataaaaccgctggaggggttctggatctactctaaggggacctcgtctgttccgatcagatatgacacaaacccggtccagactccgccgactgcatacctgaagaagggatggaatggtatcgggtttaccggaacaacaccaatagaagcaaagttcacactcctttccgtgcaggataagtgggtgaactgtgcaggctttaatgcccaagcccagcagtatgacccgatgatcatcaagggaagcaatgatgcaaccctgatgtatccgttccgcgggtattggttatacatgaccgcagacggagtccttgcagcaaacgctgcataaaaattttttataagagtcgttcctgccttgtaaacggtttgatattcagaactgatctggctgcatctgatacgacatctgtcagaccctttggtgcatacacaccaagccgccattgacttcttcttgtctcgttgagagtggtgacgaggggcgatacctcttccagccggcagagggaatgcttgtcctgaacctgaacctccatccagatatcacggggaaatgcaggaatatcaaccatcacctgttcaggagtaataccagcctcatccgctatcttttcagcgagtttgcgctcacgaaggaatgattcagaagtaatcaggtgaacctccctgacatcatcttttccgacatacaatgcccgtttaaagagccggcgttcatagaggttttgtgcaagccctgaaacggacggattgtctgcatgaaggagatgctgcatacaggctgcatcatctgccatcaggagagaacggagaagagacggatcatctttgatgtattcatacaccgccagggagaacatcttctctgcaatccgactgacatggtgataatacaccgcaggtcgcatcaaagttcgtgcaatcagcagtgattctgcggcctggacccctgacatatcaaggacaattccagtctcacaaagccgcatcgccctgataagccgcatggcatcaaccgttccgtacggcaccccggtgtaatgggcatcgcggaggaggtagtccatccggtcaacatccagatctccatgaatgattcctgaacactgggatctgccgttgatgagctgatagatgatctccggatcaagcccggcctcatatattcgctctccaagaattccggttttcagctggtcagatatgtcggtatgtctctttttcaggatctcctctgaaagaccttctattgcatgggagaacggaccatgaccgatgtcatgaagaaggcctgcaaccgtgatgtgggcatgatcctcacgggggagagcgagccgggttcccagggaatgggccaggtgcatggtccccagcgagtgctcaaaccgggtatgatgtgcgccaggatagacgagaaatgagaagcctagttgtctgatatatcggagacgctggacctgtggcgtatccagaagaggaagaaatgatgaatccacctggatatacccatggaccggatccttaatcgatttcattcggtccccacatgagttatgatcgggcaggtaacatagaaaaggatgatcaccttcctgtccggtggaaccggcacacccaaactcctcgagggcgcccggaatatgcttccggattcagatatatcagttatcgttaatacgggagaggatatctggtatcagggcggacacatctctcctgatgttgataccgtgatgtatctctttgccggtctgcttaataccgatacctggtggggcgttcggggagatagtttcctgacacatgacgtcttgaagactctgcttccggcttcgtacatgtccataggggataaggaccgggcagttcatatcgcgagggctgagtggctgaaaaagggtatgacactgacccgggttacacagcaattgtgctcgcatttcggggtatcaacgactattctcccgatgtcagactcgccctacaccacctatgtgcggactgcgaagggagacatccatttccaggagtactgggtcagataccggggcaacactgatatatgtgcagttcttcatgtccccgatgagcagccaccggcaacaccggaggtcatagatgctatcaggaaggctgaagtagttatcatcggccccagtaacccagtgacaagtatcctgcctatcctctcctgtaccggagtgagggaagagcttgcacagaagaaagtaatagcaatcagcccttttatcggagaaggcccggtttcaggaccggctgcccagctcatgaagacgatgaaatacccggctgattccacgggagtcagggcactatatgcggatcttgtcgatgtcttcatacaggacgagcgggatactgcccaggttccgggttctgtccggttggataccctcatgaagacccctgctattgcagaacgtctcatgagggagatccttacccgattatgacaacgatattccaaagagcgacataaacagggcaagtaagaagctgagaatgccggagataacttcctcattcaggaggctgcttagatcaaacgaacccgaattcatgccagagaacagctgattcaggtcctcaccggaaaaatcactcgcactgttccctgtctcttctgccgctgacagggatactcccagcagaacaaaacagattaaaaccgccgttaaactgcgtatgaacctcatgcacatatgtagggatgctggcattattgagttatgccataattcctgcacggttgaggagatcatcagcactctctcgtgccccggcaataatcttctcttcatctgggatataccggttgtacatgagaatcttaccctgacagatgaccgtatcaacgacactgccctccgctgaataggcaatatttgagaccgggttatgcaggggtaccatggacgggtgagagagggatatgagcacaatatctgcaggcatgccttcctgaatcactcctccctgatagccaagggccttcgctccccaggaagtccccatggagagggcttctgctgccgggagaagggtgtctgaattccagaagaacttctgacagagggcagcggtcttcatctcttcgagcatatccaggttattatttgatgagcatccatcggtcccgagacagacatttaccccctggtctttgagccagtgatagggcattgcccgcccggttgcaagcttcatattactgaccggattatgggcaacagaaaccctccgttctgcaagaagcctgcagtcatcttccgagagccagcatccgtgtgccgccacggttcgttcggtcaggcatccggtcttgtcaagaagggctgccggggtcataccataggatttctgacagtcatcaacctcctgttttgtctctgcaaggtgggtatggatgattatcttctccttttggctgtagtcggcacaaacctcgaggtgctgcggtggaacggtatagggtgcatggggggcgatggcagacgtgatcagggacgtattcagtgaccgtacatgatgaacaaggtcttcggtggctttcagttcagcctccatcttggcttcgtctccaaaggtgatgatcccatgactgagtacggcgcggataccggattcttgcaccgcccgggccgcatccttcatgtagaaatacatgtcattaaaggcgatcgttcctgaccgaatcatctcaagacaggcaagtttcgtcccccagtagacatgttcgccggtaaggtgggcttccagtggccagatcttttctgagagccactgttgcagatgcatatcatcggcatatccacgaaggagggtcatggcagcatgagtgtgggtattgataagacctggcatcgcgagaaatcctgatccgtcaaggatgatatctgcttcattcctatgattacgggcaatatcagggccgcatgtacggattgtaccggtctcatcataccagatgtcggaccgcgttttatcaggaaggagaacaccggtgatgagcgtggagcgacattttaaaaataaatcttcgtttttacagggtgagatatcctttggatctgccatgaattacccatactgtcttcttgtatcaccaataaaaccagatgatagggtgagtccacaaagagttttgagcgttcccgctcattgagtaagggtataatatgcgtgttccgatcaataccattactcctgatacgccctcagccgaggttatcggatgggcacatgagatacgtgaccttggaggtcttgcttttctcttaatacgtgacagaacaggaattatccaggtaaccgtaccaaaaaagaaggttgcaccggagattgctgaaacgatccgagcaatatcccgtgagtctgttgtaagggtcaccggaacggtcaaacctgaagggaaagcaccgggcggcagagagctcatccccgatgcaatcgagattgtgagcctttccgcgacccctcttcctctcgatgtggcggaaaaagtgccggcagaactcgacacccggcttgataaccggtttttggatgcacgcagaccacgggtcagtgccatatttaaaatccgaaacgctgttcagcatgcaacacggaactttttctttgaaaacgggtttatcgagattaatacctcaaagatcgtcgccgcagcaactgaagggggaactgagctcttcccgatcgcatactttgagaaggaagctttcctgaatcagagcccgcagctctacaagcagatgatgatggctgccgggtttgagaaggtctatgagatcggtccgatcttccgtgctgaagagcacaatacaacaaagcacctgaatgaggcgacatccatcgatattgaagtctcattcaccgatcatctcggggtcatgcagacgctcgaagatctgataagggacatctaccagtttgttgacaagacctgcagtgatgccatagccgatttagggcttgatgactttgccgttcctgaaaaaggattcccacgtcttccctatagtgaggcgatcgagattgcatctgctacatgtgaagaggatatcgcgtatggtgatgatatcggaacggctgcagagcgtgcgattggtgaagagatgggacgcctgtactttatcgtcgactggccatcctcaatcagaccctattatgccatgccgtacgagaacgatcccgagatctgtaaggcctttgatatgatgcaccccaggatggaactctcatccggtgcccagcgggtccaccagcatgaccttctggtagagcagatagcgaagaaaggattaaatcctgagaactttgagttctatcttaacccattcaggtttggtatgccgccccatgcgggctggggacttggtgccgagcgtctcgtaacgaccatgctcggtcttccaaatgtccgtgaagcagtcctcttcccccgtgacagacaccgggttgttccctgatcatgcagtcattcatcccagacaccatccttccgacaaccgtcgtcggcagctatccgtcacagccaaagcgaacactgagaagcttgtttgatccctaccacggagcggtagaggaggcggtatcccttcagaaaaaggcaggcattaccatcatatcagacggtcaggtgcggggtgacataatcggggcatttgcctcaaaactcccggggatccggggaggcgacgtcatcggccgggtgatgccccctgatcaggcaataaccataaaagatacggcatacgcagtcaggcagcatccatacgtgaaagcaatcattaccggtccgtccacacttgcatacggattgcatcttggaacacctctataccggaaccggaatgaactggtcccggatattgcatcttcccttgtggtggaggctcagggccttgcaaagaccggggcggttatgctgcagattgatgaaccaatcctctcgaccggggcagctgacatggatgttgcgaaaaaggcaattagtaccatcgcaaaggcagtttcaatcccggtctgtctgcatgcctgtggaaacattgcacatatcatcgatgacctgctggcaatgcccattcagatccttgattttgaagggagtgtaaatgcagaaaacctggcctcattatccgggaaggatttaaaagaccggtacatcgggtatggaatcgtggattcgtcctcccctgtacttgattcggctgatgatgtcaagaggcggctttggaagggaatagatatccttggggctgaacggatccttcctgacccggattgtggtcttcggatgcacactccggagagtgcatacgctaaactgaccaggcttaccggggtcgtttctgaagtacggcaggaaattgggaatttgtgaaaacaatgattgcgtctgaacacacatctgataggtaacctgatgacgcctggcattccttcattgaacggaaaagagctgttggcagcagtgctgttcattgcatcggtctttatccttggcctgaagctgatgaacccgactccgctcgtaatctggtataccggtgaggattatatcatccagaccgaacggattggggatatatattcggcaactgatgttatcgtgctcattgtctcgtccctgataatttgtggaagcgggctttatcttctgctctatgaacagatccatcccattccggcactccaagcacagggagcgccacccctgccatatcaggaagcgcctttaccattctcaccattggaagatagaaaacgaaaatgggagacggttcttcccacactcaaagaggatcagcagctcatctatcagaccatccttgatgcagacgggattatcccccagagtgatatcgttgaaaagaccgggctttcaaaatccaatgtcagccggtctcttgatatgctcgagagtatggggctgattgagaagagaaggagagggatgggaaacctcattctgctgaaatgaggagaatatggagaaaaaccggatagtatttcttgcagtgctcctcgtctgcggcattttcctctcggttgcaggtaatttcctgatgggtgtccgggcaccggtgagggaacagagctcacttttggaaaattaccttatcatgcagtcgatggccgggaaaaatgcatcatatgccaatcagacatacatgattggagactccggtattgttgtaagctttaatgatatcctcaatattcgtgatagtccggtccacgagacaaagggggtggtgaatgccaccgctccacttacgcttccccgctccgcttttccgaacataacgactccctgagttcccgccggagaagtttccacccaccaactcttggtaactgattgagaatcacgagacgacggggtattttataccctgcaagctgctcacggctccagccggagagttcctcaagggtaagggtatcctctttattccggaggacaaccgctgctgcggggatctcacctttttcttcatcaggacaaccaaagatagcaatatctgagattttcgggtgattgatgaggacgttctcaacctcggtcggataaaccttccatcctgacataatgatcatgtcctttttccggtcggtgatgaccagcatgccatgatcgtcgatatacccgatatctccggtcagaaaccagccatcttccatgaagacttcttttgtctcttcaggctggttccagtatcccagggctacccccggcccgcgaagtgctatctcaccagcatgtggcgatgtaagttcctttgccgggtttccaacttcaacgatttttacctccgcatacccgaccggttttccaacgctgttatactcatccgcagtcggatagtcttcaggccggataacagtcccgcatccgagaacgatcgtctctgaaagaccgtaggcattgatgaccggaattttaaaccgttcattgaactttttccaggtcggtgagtgcatcggcccgcccccactgatgatacggcggacagaggtgaagttatcctcggttcccgggggggtttcagtcagggcatgaatgaccgggggcattccggcaaggatcgttatctgatactcacgggtcagactgatgtactcatccaggttataccgctccatgatcacataggtcccgccggcgcgaagcacagaaagcccccatgaaatcccgacatgtgccatcggatatatgccaaggtagatgtcatcacatgtcagatcaagagcctccccctcggcctgcagggcggcaagccatccgctatgagtcagcatggcacctttcggcctgcccgtggtccctgaggtatactgtatctggcagacctgatccggagagcagggtaccgggcggagaggatcatgagacagggtgagattctcccaggagtatttgcctactcctcccacctcaacaatatgtaccagctcaggacaggactccttcatcaaaccggtgatatcacgtgaactaaccgatgtgatgagcatttttgcaccagagtcgcggattgcataggcaagttcatccttccggtacacgatgttggtcggaaccgctacaagaccggcacgccatagtgcaaaatagctgatcaggtactcgggtgaactgtccagatacaggacaacccggtcacctggaaccagaccaaactcttcacaaactacagcaagagaaccactgagtcggtggagatcggtatatgtataggaccggttggattttgggtggatgagcgctattttatctggaaacctggcctgatgggtatcaagaaatgtggatatattaaacataacagggtactctcacttgtgtactatgttgtacatagatgcccaaatagcactacctccatgcattggaaatggagggaaaaaagggttggttactggtactcaggtggctcgctctttttcggcataccacctttgaaatgagtttttacccgatcatatgcctcacgaagccgctcgttcatggtcgggtggaccttctcaagggcacgctcaaagtgctctttcttcacataatggagctgatcccgcatggcaaatatggctgcttcacgacagagtccttcaaggtcagccccgacatagccgtctgtccgtgacgcgatatcaccaaacaatttatccagaaccggatcttcaatagtgatcctgaatttttcaaagatctcaaccagcatcctgcgacgtgctgaccggctgatagttccctgtgacggggtgaccgtgcggatatattccatgagttcaggccctgatgatttgacttcacgggggagtgttccggctagtatctcaaagtcgtcctcggtaaagttctgggtggcatccaccagtgattccagtgcggacccctcgatgggtatgagtcgtgcatggatctttaaaatgtcaacccggtcagatgggcccggttcaccgatatagatgagccggtcaaaccgtcctgttctgagaagggcagggtctacaatgtcaggccggtttgtcgctcccatcacaaccacgtcacgcagctcaaccagaccatccatctcggtcaggaactggtttaagacactctccatagtgtgactgtcgcccgccgttcccctggcaggagtcagggcatccagctcatcaaagaagatgatggcaggggagacctgacgtgctttcttaaagatctcccggaccgcacgttccgactcaccaacccacttggacaggagctggggacccctgacagcgatgaagttcgcacctgactcgttcgcaaccgcttttgcaaggagggttttgccggttccaggcgggccatagaggaggacaccacggggtgactggataccaagatcatcgtacttctctcttctggtaagggggtactcaaccgattccctgatctcctcgatggcatcagacaaccctcccacatcgcgccatctgaggtgggagacctccagcatgacctcgcgcattcctgacggggtgatctcacgaagggcctggtgaaagtcctttccggttacaaccatggtctccaggacctcatcagggatgatatcctcgtcaaggttgatgtgagggaggtaccggcgaagggccctgattgccgcctcacgggatagggctgcgatatctgcaccggtatatccgtgggtccgttcggccagttcctcgagatttacatcatcatagagaggcattccccgggtatgaatttttaatatctctatacggtccgggtttgaggggacgccgatctcaatctcacggtcaaatctgccaggacgcctgagtgccgggtcgatggcatcaagccggttcgttgctccgatgacgacaacctgcccccgttcctcaaggccgtccatcatggtgaggagctgggcaactacccgccgttcgacctcaccggtcacttcctcccgttttggggtgattgagtcgagttcatcgatgaagatgatagagggggcattctcagctgcttcttcaaacacttcacgaagccgctgctcactctccccgtaatattttgaaatgacttcggggccggcaatcggaatgaaatgagcccctgactcattggcaaccgcctttgcgatgagtgtttttccggttcccggtggtccgaagagcagcacgcctttggggggttctattccaagacgccggaagagttcaggatgccgcatcggaagttcgatggtctcccgaagccgctggagttcatcacgaagaccgccgatgtcctcgtaggtaatctggctgatgccctcaaacccgctgataggactgtctgatatgatcacctcggtccgctgactgatgatgaccgcatccgggggatccagctcgatgaccttgtatgccaccatctgcggctggacaaatggcattcctatgggaataggtaccgagtcacccattgcgaccggataatctatgaggttgtgatgtatggttgagggatctgccatcggcacatttttcgggagatcctcggggggtgccagcaccacggtcgcggcagggatcgtctcttccaccttggttattttgaccgtgtctccaatcgagacatttgcattcatccgggtaaaattatcaatccggatcttctgctgattccagtctgccagctgggcacgccagacctttgcaacggttacggacctgccggagatccggatgatgtcgcccggtgaaagtcgcatctggttcatagtttccggatccaggcgggctttccctcccccctggtctccgggatatgcactatcaaccctgagatacaattccattacctaaccatcatatacgccgggacttaaaagtataggaaccatgcgtcttctcgcatttgacccctttcacggcgctgcaggggatatgatatgtggagctctcctgagccttggtgctgacaaagagcaggtcatgcgagcgatgagttctgttgtgcagactccagatagtgagatagtaaacaggtgtggcattgctgccgtgaaggtccatacccgtgccggtcctgcccaccggactctcgaggaagtgctggatatcgtccgaaaggcacatgcccctccggcagtaattgcgcaggctgaacacatttttatcaggatcgcaaaggcagaggaggcagtccacggaacgcaccatgttcattttcatgaagtcggcgccgacgatgcgattgccgatgttatcggttcctgtatggcggtacatctgcttgctcctgaaaaaatcatctccctgccggttgctgtcgggaccgggatgctgacctgtgctcatgggacctttcctgtgccggcaccagcaaccgccgagatcctctcatccggcagacttcttgtaatgtctggagagcataccggagaacaactcacccccaccggggcggcaatcctctccgagttctgtggagaggggaccccgtatcttcctgtcggtatcattctgaagaccggatacggggcaggcagcagggatgatccccgatctccaaacgtgctcagggcatatgtgatggagtgccagggcctgtcagaagacagggtggacatccttgagacgaatgttgacgacatcaccggcgagtgcatcggaaccgtgctttcacttgtaatgaaagaaggggcacgggatgcctgtgcagtgccggtcctcatgaaaaaaggacggccggggcatcttatcagggtcatctcaccggctgaacggtcaggagcgcttgcagagatacttgccagggaacttgggacactgggtatcagggttaccccggctgttcaccggtttattgccgaacgggagatacaggaggtaccggttcagatacacggggaggaggtcaggtttccggtaaagttcgggtatatcggagatacctgctacctggtaaaaccagaatacggggttgccgaggagtatgcaaaaacccacactattccggtgagggatgttctccatatcgtgacggaagcggggaaaaaattcatcaggtcaggtgagagccgatgagattaaccggcgtatcctcaggaaatgcagcacttgatgacctgatggggaccggatacccccgcaagatgatcacccagatctttggtgagcccggctcaggaaaatcttccttatgcctcatggcggcagtctcagtcttaaagcagggtgagtcggttgtctatttcgatactgagagtttctctgccgaacggttcagccagattgccggtgatgaggcagcgactcttgctgaccggctgttcctttatgaaccagtggattttaaccagcaggctctgatgatacttgaatctgaggatgtgatacgggagcagaaggcaggaatcatcatccttgattctgccaccggcctgtaccggaccgaacttgaacatatccaggaggcgcttcagaagtttaaccgccagatgacgatgctccttgggtatgcaaagcgatatgacattccggtcctcatctcaaaccaggtatatatggatatcagcagaggtgattttgctcccctcggagggaccggcctgtatcatctcagtaaaatcatccttcagattgaacggcgggacaataccaggaggatccgggtcatgaaacatcatgcacggcctgaaggaacctatattgatgtcatccttgtccaggagggaatcagaattattgatgagtacctggaagacctccagatcgggaagccataaaccctgacaatacccatctttcagaagacacccacacagggaagaatatgatccgatcaatatttttcgcagcggtttccatcaccctgcttttctcatctccggtgtttggaatttctatcacttttccccctgaatcagggccatataccggggattatgttctcatccaggagcccggacgatatacgcttgagaacaatgtcacccatacctacccggtcggtgttatcatcacctcctcatcggtcatccttgacggacagggatatcaggtacgtcctgcaaaaaccggtgatccgtcggttgggatctgggtgacccttcttgattcacagggaaaaccagtcaccggcgtccgtattcagaacctgaccgtccatgatgaggtgaccggtatatatcttgaaggggctgactcatctgagtttccctggggacgtgatcgctcgaaagattatgcagtgtctgatgccactttctctgatcgggatataaaatgcagcggtgttacgatcaccggctcacggataggtatcgcatcgaggggtttgaaaacaccggcaatctggcagtcagagataaagggaaatgagaaagggatctccatttcagacggtgctccggatatcagggaccttgtggttaccgagaacaccaatgcaggcattcatctggagagaacaagtgggggagttattaccgggtgccggattgaaggaaaccagggccccggcattctcctggaccatgcaaaagggattcagatctggaataatatatttgataactatgtgaacatcagaaatgccgcaagcgaaggggcattactgtatcagatcccatcaaaccagaccaatattatcaagggtcagaaaacgggtggaaacctctgggcacagggaggggttccggtctattcatcccatatgatcgctgacgcggatcatgacggattcggtgatatgccctacatcgaatcgggtctcatcgatcaataccccttaatcccggccgggagtggttttatcccggtggagatacctgaaccagaaccaattcaaaccgtgatgacaccggttccggtctcaacgccatttaccatcatcaccgggattcatgccgtcatcaccggggattccatcccgacagagatgaaagccggtatgtcatacccggtaaccatcaccctccttaatgatggatctgataactggcttgatatgcatggagttggtatcagggctgtgggcgatgcagcgacctggggtcctgaatggcttcctgttccttccgggattaattcaaagcagttttatacgtttaattttgagttaaaggcaccaacatcacccggaacatatgagctttcctatcaggcggtccggggggggcagggagtttctgttacattcggtagaccacataagaaggtcgtaacggttcaatgattgagaaaaagaattattatgagtagttacggcctccgccatatcccctgccacggttatatcccccgccgccggatccacggtcaaactcccgtcttggctgcatgggccgtgcttcatcaatacgcatggtccgcccctcaaatacggtctggttcagagcgtccatcgccgcctgggcttcttcgctggtacccatctcgacaaatccgaagcctttctgctcgataatttttacactgacaacgtcaccatactgagagaagagatccttcagctggtcttctttcacagagtacgtcagattgccgacgtacagtcgctttccttccataagatatcagacaccgtgtctctttcctttcacaatctatttagacatgagaggagtgtgatcatgcccctttcacccggcaatctgaccgacaacgggagatttcaccagcatacatctgactgcccggatcgggtattcgccaaactttcgagaagctgatcatgaaaaaagacgactcatatgttattaataattatgtttgggaaggagagaatgacccaaagattgatttaccgtgttgtttccagggaatcaccaaccctgaatccggttttctcatccaaaaaaaaagggatgtgagcaggaccgggtgttcagagaacccgagcaggaatgaacctcatcgacaagttatctcccatgagctcaccagataagtcatgcctatatgaccggctgcctgtataccgcccttttgggaatgcacgagtggggcatatataatccaaggtgtctgccgcgcaatttcgccgaggagcacccattcccatgcaggggggccgggatctgtgattcctgggaacgaggaagagccattgtgttcgtgtgaagccaagaaggaagtgactcgaatgtgttactctggcaaatacgcatgaggtctgtcgtgagtatcctggattgtggatacatcagcgagaatttttcaagaaaagaaggaaggataagggaaaagactgagtataagaataaaaagagatctgccgggatcattcctgctgaatgattgaaattatggttttgactacggtttgtatgacaggatctactacatgtcccaaggtgtactggatcattgaaacatgagcagtaaacagtttatcaggtctgatataactcatctcttttaaggttccgaatattaggtctgacggatggagggggatactatacgtatctgagtgaaattttgaggtaatttggcataggatctaatcgtccccggttataggtgcaatcaccaatgcagggcgtcgttttacagaacttaaatcagagaacggaaacggtataacgacaatatctccttttacaaatactcccatgcttcatcctcttcagatgtgagccagtcacatgcaagaactcgttcactcaaatacatggtctcacaaatgtgggcagtatctatcacaccagaacccttgatctgacaaaaactttgacagttaccatggtcaacgatctggaatgatacaagtccggagacaatcgaccgacagaagaaataaaaaccaacgcagtaaaacgaggaggaaaaatagggttatacctgtggtactgtcactaaccaggtcgtactgttcgagtaactgtaccgctcaatcttaaaatcaggacatatctctgacaataacgccatgttagtccccacttcttttgaggacaacccagtatccctggcgatatactttgacttaaaaaaattggatcctggtttcatctgacatttgaggtaatttatcagacagatctgacgctcattgtattttatgggaaatttactctgtaaaagcatgtctatctccataagtacttcgttgaaacattgcaggaggaaaaccggccttggtatcggccgggtgaagttcaggtgtggtcaggagagaagaattggaggacatgaaaccctctcctgaccaggggagtttccttttccggatgagattgatacaacaggtgtaggaggacatgttgaacacaactcacctcacagagatcctgccagtcatccaggagttatgtcctagggttttcacagggctctgtgtgacataccagtgttgcccgaaacaggttaaaagggatatggataaaaccactggaaaacagtctgaaacaatttattgaaacaatcgtgtgtttttttctcaaaaagaatcataaccacgatagctgatcgatcaggcgatttctcatgggttgcatctggttttcagaaaaaattctgtgagagagaaaccagaagatattagatgaaatttaaaatttctcccagtttcaacagttgcaaccggttgcaaccatcgattctgtcagagtattaatcagatttccagaggatcaatgtgcggatctgttcaggtcgcggagaagggatccacgctcaaccatgtatcagaagacgactgaatttatttatatgctcttcttataccgggcttgataacacacgatttaggcaaaatatgagcaaaatctattaatactatacttcatatattaatccttgatatattatggcagatttaccacttgcagccgttgcccgtgtcgcaaagaacaatggagctgaacgggtcggagcagatgctacccaggcacttgttgaacatgcggaaaattacctggcaaaacttgtaaaggaagcaaacaaactctccatccatgccggtcggaagactctcaaggccgaagatattgagatggcagcagagaaattcgcctaacctctttttcttataaggacattattaccgtagtcctttttaagttcatttcacagtatacgaaaaaccagattcatgagaaaaccccctataccgacaggatttttgtccatacatttttggttggggatcatcaattgacaatcctaaccgggggtgatgttacccccagtctcctttttcccagttcacgcaattttcttcgtatgaatccagataataacacagtttatggttcttatttatttttgctgaattaagaagcatatttttaagagtttcgaataaattagttaagatttattaaatattacaaatattagtcaatttcgcagaataattttgatgaggatttaatttaagaatcagaattattgaaaaatacattaggagagaaatataattaaattcgaccattatttaaaagtctattctatatttcagatcagatgtacgagctaatctgatctcaggaagatccggcagacatacgtctgacaaaatatttcattgatatagtgagtatcacatctccaccctttgaaacacaaaatcttcgaatatataaataacatacttaattgggttgggagcataaggtgtcacatcaacaaaggcactcatcccagagaatgtacggccacaggttaatcatcccttctcacgctgttccattatcatcaggggtcgtgaagagatcccggaccatcttcaccgcacacaggtcaccacacatggagcaggtctccttttcctggtcccgatcatggatactccgtgctacttcggggaataatgaaagattaaactgtttttcccagtccagttcctgacgggcttttcccatcataatctcacggtttcgtgcatcctccctgccggcgagcagatcccctatatgggctgcgagaacagaggcccgggtcccttcaataatatcatgaacccgggggagagcgaggtgttcactgggagataccatgcacaggaaatttgccccatgcttgcaggcaatggcaccaccaatcgcaccaaccacatgatcatacccggacgcaatgtcagtcaccagcgggccaaggaggtaaagcggggcataatcagtcagttccttgatcatccggacattgtatccaatctgctcaaggggcatgtgacccggtccttcaatcatccgggggatgccgaggtgatgagcccttcgtgcgagccggccaaggtttagatattcaaccgtctttgcctcacgtgtggcatcttcatgacagcccggacgcatcccgtcaccaaggctgaccacgacctggtattcatcaagtatctcacacaggtaatcaaattcactccagagagggttctcctcctcctgtgcagccatcatagcgacatgaaacgatcctccccgtgaaacaacccccatacggcgcggatcttcccgaagggatcggagcacatcctggtttaccccacagtgcagggtgagaaagtctaccccgtccctacagtgctcccgaatgacagtaaacaagaggtctgcatcaacatcccggaccgatcctgctcttctgacagcctcgtagataggaacggtcccgaccggtaccggagacgaaagcaccatacggcggatagcaggtaaatcaccccctgtcgagagatccatcaacgtatgggcaccgttctgaatcgctgcctctgctttctccttttcgagggcgggatcacagagaccctgggacgtgccaacattgacattgaccttgactttgcatccttcaccgatggcacagggggggcaaagccgtctcggatttcgggggactactacccttcccgcctgtatcagtctgattaaccggtcattatcgagtgattcagcctgagctattgtattcaggacagatgtatcaggaagggaatattgggtaggtaccatatcctacttgttgtatgccggggaatatgatagtcacatggcagtaaaattcatcccagggagagggatgtatgcaaatgcctatgttgcacggggtacggttctggttgacgccggtgtgaccccgatggcaatagaggcgcatcgaaacaccatcacccatatcatcctgacccattgtcattttgatcatatcgcctaccttccggctctgcagaagatgaccggggctaagatctgtattcatgaggctgacgcagaaggactcatacatgacaacctcagccttgcaatgcatttcggagaacattctcccggaatcatccctgatatcatcctccatggaggggaaataattgaagggtatgagatcatccacactcccggccatacaccgggaagcatctgtctgtatgacagaggaacagcagaactcatctccggtgatacggtcttttctgacggcgcattcggacggtatgacttcccgggcgggagcaggagcaccctttccgactcaatacagaaactgacccagctgaaggtcgggggcctataccccggtcatggaattcctgcacgggagaacggagagcggtttattaaggcggctgcagccctcatacaatcaggatatggataagggagcatacatcctcattttgaagaatgatgaatgcaggattcaggtaggagcacaaggtcagagaacattttctgccggatggcatgcatatgttgggtctgccctgggaccaggagggttttcccgggtaatgcgacatttcagattgaatcgtgataaaaataaaagcccccgctggcatattgactcactcctgctttctccctattttcaggtagtcctggcctgttgtatccataccgaagagaggattgaatgccatcttgcccggcatatgaccgggactgtcattgtgggatttggatcatcagattgcacctgcgagggccatctcttttattatccatctgatccctatgagtatatactccgtaatattcagtcttttgctgaaaaggagagaaatacgtttcagattgaagttcggacaccctgacctgaccggtgattggacatgaagggatattatatgtatttataaagcagataccaaactcaatcaccgttattcagaggtccacacatgatcaaagttgcaattaatggatatggaaccatcggaaagcgtgttgcggatgcggtctctgcccagaaagatatggagatcatcggggtatcaaagacaaaaccatcagccgaggccctgattgctgtccagagagggtacccgatctacattgctgacatgagcaagaaggatgcattcgcgaaagctggaatcccggttgcaggttcagttgaagatatgctcaaaaaagccgacattgttgtagatggaacccctggcggtgtcggtgaatcaaacaaggccctgtatgagaaagcaggggtcaaggctatctggcagggcggtgaagatcacgaggttgcaggattctcattcaatgcccatgcaaattacaaggatgcgattggcagacagtttgtcagagttgtatcctgtaacaccaccggtctctgccgggttatcaaagcggtggatgatgccttcggagttgtaaaagtccgggcggtcatggtcagaagaggagccgacccgcatgtcgtcaagaagggcccgattgatgcggtcgtccttgacccaccgaccattcccagtcatcacgggccggatgtcaacaccgtccttccccacatcgatattgtaaccatggccatgatcgtaccgacgacccagatgcatatgcacgccatcaccatagaactgaaaaaggaagtcagtcgtgatgatgtactcgccgtcatgcgcagtcacaaccggattggtcttgtccagccaaagactgcgatcaagagcacggcagaactcaaggagtatgttatggatatgggccggccacgttctgacttatgggagaacggcatatttgaggcatcggtgaatatggttggaaaggaactcttcttcttccaggctatccatcaggaggctgatgtcgtaattgagaacgtggatgcaatccgcgcgatgatgggcgaagtcagagacccggagacttcaatcaggatgaccaacgaggccatgcagtttactgccctctaatcactcatcctattatcacgatccaatacaaacctcctcagaatggatacatacgcccgtgtaatacggaacacggtcgaggtcgttactgacgaggaactgcgttccctccttgaccgtccggtcagaaaggtctacgcaggatatgagccaagtggagagatccatcttggacacctggttactatcaataaactgatagacctgagagatgcaggttttgaagtcactgttctccttgccgatctccacgctttcctgaaccggaaaggaacgatggaagaggtcaaaaaacttgcagaatataaccgccgctgttttgaagggctgggcctgactgacatcaaatatgtgctcgggtccagtttccagctctccccggagtatcagattctggttcatgagttgtcccaggccatcaccctgaatcgtgctaagcggagtatggatgaggtcggacggcagatggacaacccgaccgtctcacagatggtataccccattatgcagatggctgatattgccatgcttggtgttgatgctgcacttggcggaattgatcagcggaagatccatatgctggctcgtgagtatctgccatcgaaaaactatccctccccggtctgtattcatgtccccattcttcaaggacttgacggaaagaagatgtcctcttcccagggcaattacatatccgtagcagagtcggaggaggatatcagaaaaaagatgaaaaaggcgttctgtccaccggaggtagaagacaacccggtcctgcaggtactgcagcatcacatcttcccacgacttgacaccgtaaccatcgaacgaccagagaagttcgggggcaaccggacatttggatcatatgaagagatggaacaggcgtatgccaagggtgagattcatcctgctgacctgaaaacggcagtcgcagaaagcctgattaccatcctggcaccggtccgtgagtatcttaaataagttcagggtggtttcttgagagatcgacagacagatgaatttgataagaaggtcgatgaactcaggaccaaaataaagggacttgaccagctgaaggtcagggatgatgtatttgatgaatacaccctcctcggcctctataaacttctttccaaggggtggattacggcaatgggggggcccatatccaccggtaaagaggcgaatgtctatcttgccgaccgggacggaactcctgtggcggtcaagatctatctgacacggactgcgaattttaaaaagatgcaggattacatcactgctgaccggagatttattaatatcgggaaaagcaggagggatgtaatctttgcctggaccagaaaagagttttcaaacctgaaacgtgcagaagagagcggaatactggtacctcaccctctggtttttgaccggaatgtcctggtcatggattttttgggagatgaacatggggcatttcctcagctgaggcttgcagagtatgaagatgctcaggcggtatatgacgagatactggaggatatcaggattctgtggaggaaagcaaaactggttcatggggatctttcagaatataacattctctatggcaaaggacatccatatctgatagatatgggtcaggcagtaaccttggatcacccccatgctccgggttttttaaaacgcgatctggaacagctgaaccggttctttagtgagcagtgctctacaattgaggtatcagacacacttgatgagctgtgcggctcatccctacaataatcacatttcagagtaattttggagtaattatgcaacaggaaacacgaataacccaggaacgaataggggttcttattggaaagaaagggcttacgaagagggagattgaggagaagacaaaaacgcggatacaggttgacagtgaggaggggctggtcagcatcgagggtgaggatgcagacgggtttatccaggctgttgagaccgtaaaggcaatagcccggggattttctcctgaacgggcagcaatattacttgaagatcctgacctctatcttgagatcatcgaactctctgaatatgccggaagtgactcaaaaattgagcggataagggggagaatcatcggacgtgacggccggtcacgagcccagatccaggatatgacggcgacagagatatccgtatatggcaaaaccgttggtatcatcggcaccattgaacaggtaaagatagccagggaagcggttgagatgctcatcaaaggtgtgtcacatgaatcggtcttctcattccttgaaaagaaacgccgtgaattaaaacaggatatgatcagttactactactaacaggactttcatgccctcttctttcccgttgctttggtgaatccatggagattgcatcactccccctccccgactcttttatcagagcctgtcatgcaaaggggatcaggtcactctacccaccacaggcggaatgtatagagaagggattattggaagggaaaaatctcttaatatcgattccgactgcaagtgggaagaccctccttgccgagatggcgatgtggtcacggatagccgcagggggaaaatgtctttatattgtaccactcagggcacttgcatctgaaaaatacgatgaattttcaaagaaaggggtcatcagggtcggtatcgccaccggtgatcttgaccggaccgatgcataccttggtgagaatgatatcattgtggcaacgagtgagaagactgactcactacttcgaaaccggacaccctggctctcacagatcacctgcatcgtgctggatgaggtccacctgatcgggtcagagaaccggggggctactcttgagatggtcataaccaagctcaggtacacaaatccagttatgcagatcatcggtctgtctgcaacgattggaaacccggcccagctcgcagaatggcttgatgctacgttgatcaccagcacctggcgaccggttgaccttcgtcagggagtttattataatgggaagatacgattttctgactcggaacgtccgatccagggaaaaaccaagcatgatgatctgaacctctgtcttgatacgatagaagaaggaggacagtgcctggtctttgtttcttcacgaagaaatgctgaggggtttgcgaaaaaagcagcaggggcattaaaagccggcagcccggactcaaaggccctcgcacaagaacttcggagacttcgtgaccgggatgaaggaaatgtccttgctgattgcgtggagcggggggccgcattccatcatgccggtcttatacggcaagagcggacaataattgaggaggggtttcgaaacggctatattgaggttattgccgctaccccgaccctcgctgctggtctcaatcttccggcacgacgggtcatcatacgggattataaccggtttgcctcaggtcttggtatggtcccgatcccggtcggggagtatcaccagatggccggacgggcaggaaggccccatcttgatccctatggagaggcagtccttctggcaaaggatgcaccgagcgttgaacgactttttgaaaccttcatcgatgcagaagcggaacgagtagattcacagtgcgtggatgatgcgtcgttgtgtgctcatatcctctctcttatcgcaaccggatttgcccatgatcaggaggcattgtcatcattcatggaacgcaccttttacttttttcagcatcccaaaacccgttcgctcccccggctggttgctgatgcgatccggttcctcaccacggcagggatggtagaggagagagagaatacactttcagcaaccaggcttggtagtctggtctcccggctgtacctcaatccctgcacggcacgcctgatcctggacagcctgaagtcatgtaaaactccgacacttatcggactgcttcatgtcatctgtgtctcacctgatatgcagcggctgtatctcaaggctgctgacacccagcttctccggacatttctctttaaacacaaggatgacctcatattaccccttccttttgaacaggaggaggaagaactctggctctccggtctgaagaccgctctggtcctgaccgactgggctgatgaattttcagaggggatgatagaggagcggtatggaatcggagccggggatctctataatatcgtagactccggcaaatggctcctccatggaacggaacgactggtttctgtcgagatgccggagatgagccaggttgtaaagacgctctcggtcagggttcatcatggagtaaaatcagagcttctgcctctcgttgctctccgtaatatcggtcgcgttcgtgcaagaactctgtataatgcaggatatccggatcctgaagcggtagcacgggcagggctttcaacgattgcacgaatcattggggaaggaattgcacggcaggttatcgatgaaattaccggagtgaagagatccggaatacactcatccgacgatgattatcagcagaaaacacctgagttattaaccgatattccgggaattggtaaaaaaatggctgaaaaactccagaatgctggcataattacagtttctgacctgctgactgctgatgaggtgctcctctcggatgttctcggggcagccagggcaagaaaagtcctggcatttctatctaattctgaaaaagaaaactcatcttcagataagacagaagagatccctgatacgcagaagattaggggccagtcttcctgggaggattttggatgttaacacaggaacacggatatactgatgaatatgatatcatcccggtcagagtgaccatcaaggaccgggcagaatttcttgatatgatcagaaagaccggagaaaaatatggcgtgactattgtgtgcctgaaccggaacatgattgccgggtttgagcatgtgaaaaccgccctggttcatgctatccgcgcctggagagaagaccggatgatcgcacgaagtcttgagatggaggtcctgctctatgccgccggtaccaggcagaccgggcagattgccccgtttggacctgaaaatggtattaatgactgctatctttgtataattcctccaaaaccggaagccgtcacatcgcttctggagggaatggaggaggtcagggatgatgacaggagtctgatgtctgaagagaaaaaaagcagacttatacagtttttcgaggtgacgtctgaagaactggaggtaactggtccggaccgcctgacagatctcatatgtgaacggtgtgctctcctggctgtgaaccggtaaaattaagagagattttttattttatctgcgagttgagaggcctttttttcatcaacaatgagctgggctgatatcccaacccatttagccagctcagggatatgctcttttttcaggtcgtcaaactcaaggccgtccaggtgaaattttgtctgccgctccaaaaaacgcctggaagccggacctaacacctgaacggttatggcaaggaccttttctgatatatctgacatagactccctgcctagggactatcatccatcatcatgatcttaagacttgagaccatcctgctaaatgacccggcaagttccccgatctcatcatttcgttcaaccgtcaccagaacgttcatatcaccggtggagatcttttcggcagaatcattcaggcttcttatatcccgaatcatggtcttactgatgaccccgatgatgaccgcggtgatgccaataccaatcagcatgatcaggtagatgatgttcccgataaagtcctgccgttcgatgaccctggtcgcactcatgtcaacaccaacgatgccggtgacctctcctgctgcattctttaccggggcataccctgaaatgacggttccccactgatcggttgtgtactcatgttctgcaaccggaatctggaatcccatcttcatctcctctgtgggagtatcatatacatcaccaatacctgcagaatcttctgatattccatattctgcatcaaccacaaaaacaatcccatctgaggtctgtttcatggtatagaggtataaaatttcagggcttgaggtctgcatcgcatagagctgatcccgcattgtgatgaattcaggagttacctcatcaccaggttgcaacgctgcaaggatatccccgtctatctgggttgcaataacactggcaagagccaccagttcatcctgcgtagtctctttaaaagctgattttgtcgctccgaatgtatagagcacactcagaccggcaataaccagaatcagaatgacaaaagcaacggtgagttttgtaatgatactatgataccactgaaccatgcagacatgattgttctaatacgtaataagcaggtttatttgagtggtgccaacgaaaaaaaaattcctagaaaggaaaactcaccggtttgcatgagtgaggatatgataaatttcagggataataatgtcccgggtagcaagttctgcggcattttttgacccaggtatacaaaagatggctttcccatcaatgatacctcccacagccctgcttaatactgtcctggttccaacctctgcaaaacttttcatgcggaatagttccccaaaaccgtcaagtctcttatcaaaaagtggttccactgcttcaatggtgcagtcatcgtgagttatcccagtacccccagtcaggataatgcagttcgcttcagaaagagccttgtgaagagctttctggatcttttcaatattatcgggaatgatttcagttctgataaccgggattgatgactcctgaaagagtgattgtattgcttttcctgctgtatcttctttttctgttctggatgtagagatcaccagaatgatcgtctgaacagatatcttttgaatatgagagggatccatgtaaaaaagttgatagatttggtattatagtattcgactggaagggttccatcagcaggatcccccacccctttgtttccactggaaagatggatcgtctttcacccacaacatctttcgcacctgcttccttcatatacaatctttcatttttcttaattttttaaattttttattatcttataataaaatcggtatctttttatgtactcgagctgacctataccacagaaagtctatcctattttttaaaaaactacatggcatgagtcaaagtaagtgctccagtggaaatgaaggggtgggggtataattcttcagacacctgaatactccactagtattattggagtaccgatcgtacaatagagggattacctgttccatgacacaagatatgaatgacagtcctggactttttgataaatatctctcagagaatcggatttttcgggaccgtgaggtactccgccattcctaccggcctcatattcttcctcaccggaaacctcagatagatcaaatagcggccattctggcaccagcacttcagacagaaactccctcaaatattttaatatacggaaagactggaacaggaaagactgcatctgtccgatatgtcggatcagagctggagtcagtaagcgccagaagggggaccgtctgcagagtcatccatctgaactgtgaagtcattgacactcagtaccgggttttggcacagatttccaagttaatcatgggtgaggatgaaacaccaagtgacaagattaaaactcatatccccatgaccgggtggccgacagatcaggtgtatagtgaacttaagaatcagattgaacttaattccggtgttttcataataattttagatgaaatagacaagctcgtcaaaaaaagtggggatgataccctctataatctcaccaggattaatactgatctcaaccggtctaaagtatccattatcgggatctccaacgatctcggatttaaaacttttcttgatcccagggttttatcatccctgtcagaagaagaactcgtttttcccccctataatgcccctcagctctgtgacattcttcagcagcgtgcagtgataggttttgcagaagatgcattggaagatgaagtcattcctttgtgtgctgcactcgctgcccaggagcatggcgatgcaaggcgggctcttgacctcctccggatatcaggtgagcttgctgacagggagaatggatcaaaggtcaccgttgaacatgtgaaaaaggcccaggcaaagatagagactgacagcatggtagagtgtatcaggacgctgcctacacagagcaaaattgtgttatactgcatgcttcttttgcaccgggctggtcagcggatcttcatctcaggagatgttacgagaatatataaagaactcactccgtttcttgagattgatgttcttaccgcacgaaggatatcagaccttatttcagaactcaatatgctcggcgttatcaatacaaggctggtaaaccggggtcgccatgggagaaccaaagaaatgtggtttgatactaatacggacaagatatgggaggtaatcatggaagagtcagatggacgtctcgcacaggttgatgaacagattgtggtccagatattacggtaaataaacagggctgaaattcatggatgatatagaccgatcattactctctcttcttgaagaagactgctcaactccccttcatgatctggcagtcatgcttgggtgcagtgatgaagaggtagaaaaacggaaaaagcaacttgaagaagatggcattatccgccggtactctgcggttataaattgggaacaggtggataaaggtgcagtgtatgcaattattgagttgaaagttgcgcctgagcgggactatgggtacgatcgaatcgcagcacggatctcccggttttcgaatgttcgtaacctacgactcaggaccgggacccatgatctccagctgctggtcaaggggaagagtatgcaggagattgcacggtttgtatctgagcagattgctcccatggaacggatccgggagactgcgacacacattatcatgaagacatacaaggaaaacggggtgctctatgttgagcgtgaagacggacaacgcctgccattctcgttctgatcagagaaaacgggatttcgtctctgaacgggcgaaagttataccaccgtcaggaatacggcgcttttttgatctagccggacagatggaggacgtcatctctctcggggttggagagccggattattcaactccctggcatatctgcgatgcagcgatcacatctattgagcagggtcatacggcatacacctcaaacaccggcatggagtctttgagaagggagcttgcccggttcctccgggaccggtaccaggttgagtataatccgatgtcagagatgatcatcaccaccggggtatctgagggcctcgatatcgtcattcgtgcggtaactaacccgggagatgaagtactggtcattgacccgtcttacgtgagctatgctccctgtgtcaccatggcaggcggtaccccggttccggtcccctgtactgagaagaaccggtttcgtcttactgcggatgtcctgatggaacacatcactccgcagtccaaggctctcatcctgaactttcccaataacccgaccggtggtgttatgagacgggaagatcttgaagcaattgcagatgtcgcgattgatcatgatctgctcctcctctcagatgaggtctacgccgaactgacctatgaaggtcatcataccgctaccgcctcaatcgaaggtctgtgggaccggacaattacactatctgggttttcgaaagcatttgccatgaccgggtggagactgggatatctctgcgcccctccggatatcactgctgccactctgaaaattcaccagtacgtgatgctgtcggctccgactatgagccagtatgctgcactcgaggcattgaaaaacggagaagaagcgatgcgtgagatggttcgggagtatcatctcaggagaaacctctttgttgacgggttaaaccggatcgggctctcctgtcatactccagaaggagcgttctatgcatttccgtccgtcaaagggaccggacttaccgactatgagtttgccgagcgtctgataacagaagctggcgttgcggtcgttccgggcagcgtctttggaaacaatggtatcgggcatgtccggtgctcatatgccgtttcaaggcaggaacttactgaagcaatacgaagaatggatgagtttatcaggtctttgccctgaacttaataataatctgtttttatccagatccgattccaagtattcgtgctgcaagatgggcagcattttctccgttgtcaactccgacgcaggcgaccggaacccctttcggcatctgcacaatcgagagcagggcatcaagaccccccatgagtttaccggagaccggaacaccgatcaccggcttttttgtttttgatgctacaacaccgggaagggcggcggcaagtcctgcaatacagataaagaccctggcatcagaagcggatatgtgttcatccaatcggtcagggtcacggtgagctgaaatgacctggtaatcataacttatttcataacctttcaggacttcccaggcctttttcgcgatctcttcatcagatgaggaaccacagataatgctgacgtcaggcatactctctccacaattaccgggatttttccctatcagagggtcatattatcccatcttttgcacatacaatatacactaggaaataatctttgttttcatcccgattatgatggatggagtgaaaggcactataatcagtctggaagtaaaatactatactcgatttttatggaagatgagttgctcctgatgcttccgggcccggttccgctgcctgaacgggttcgtgcagtcatggcccggcaggctatcaatcaccggggggcagaattcggcaatgcatatgcagatatcgttcgtgttctgaaaggcctgtttggtacgaagaataatcctcttgtcatttcaggttcagggacggccggaatggaggctgcggttgcaaactttggaaagggccgcaaaatggcccacctgatcaatggtaagtttggggagcggatgtacacgattggacagcggtatgcatccgaagcccgtccgattgagtcagactggggcactccgctgaaccttgaaagcctgaaatctgcccttgaggatgggtgtgaggtcgtcacgatggtccataatgagacatcagccggaatattaaaccctgcaggagaggttggtaagatctgccggaaatatgatgcgctctttatcatggacggggtgacctccatcggtggtgaccaggttctggccgatgactggggggtcgatgttgccgtcgtcggttcacaaaaatgtctggcagcacctgcaggtcttgcagcagtctccgtgtcagatcgggcatgggaccgggcagtaaaaaatccaccatattacttggaccttccggcgtacaagaagaatgcagccaaagatcccatggagactccctatactccggcagttccgctgtttcttgcacttcgggaggcctgtctcatcattgaagaagaaggggttgacaagcggatcgcccggcatcacaggatggcaggagcagtcagaaaggcagtacacgcctggggtattgacatgttcccaaagaccgacagtcttcatcagtactcaaataccgtaactgctgcctgtatcccggccgggtcaaatgacaaggatttcaggggagtagtcaagaaacttggcattcagatcgcaggtggacaggaccacttgaaggataaaattttccggatcggtcatatgggcgctgtatcagcccccgagcttctggcaacccttgcagcaacagaatacgcagtccgaaagaccggccatcaggttttggagtctggtgtgatggctgcagcagaggacttaggatgaagataggtatcgcggacacgacctttgcacgggtgaatatgggcaggttcgcgatcgatgaactgaaaaaacatagtagtgttaccatagagcgctataccgtccccggtgtgaaagatctaccggtagcctgcaaaaagctttttgacgagtatcagtgtgacatctgcatggctcttgggatgcctggcgggaaggaaaaagaccggatgtgtgcccacgaagcatctaccggccttatcgcctgccagctcatgacaaaccgccatatcatcgaagtgtttgtccatgaagatgaagcagcagatgatgcagaacttgcctggcttgctgaacaacggaccagggaacatgcggtaaatgtcatcaaactcatgcgacccggaacccttgagcgggaagccggaactggtcagagacagggtttttctgatgccggttcggcacgacaatagaagaggataattatgacagtgaaaaatacaggaataaaactaggttttgttgtcgcggaatttaaccgtgacatcacctatatgatggagattgaggcagaagagcatgcaaagtttctgggagccgaggtaacagagcggctgtatgtccccggcgcttatgacatgcctcttgccattaaaaaaatgctgagagataacaaggtcgacgccgttgttaccatcgggtgtgtcattgaaggggcaactcagcatgatgaaattgtggtccagcatgcagcccggaagatcattgatctctcccttgagtttgaaaagccggtgaccctcggcatctccggtccgggtatgaccaggatcgaggcgactgagcggatagagtatggaaagcgtgcggtcgaatccgcaatcaaactggtacagcggttagcatgaggcctctctcgaccaaacttgctgccatcgctccgtcagcaacgatcgagatcacggaaaaagcccgaaaaatgcaggctgcagggacagatgtcattagtctctctatcggggagcctgactttcctaccccggcccatatcaccgaggcatgtattgatgctctccggcggggtgaaacccactatgcacccggtaagggaatcccggagcttttgaaggccatcgccgaaaagatcgagcaggagaataagattccctgtactccggatcaggtgatcgtcggatgcggggcaaaggactcgatatatgaggcatgtgaagcggtcctgagtccaggtgatgaaaccatcattctggatccatcatgggtcagttatgagccctgtgttcagattgccggaggtgtaccagtacatcaccctctgcatcaggatacattccaggttgatgatagtcttcttgagaaggttacaaagaagacccggatgatcattgtcaatactccgtcaaatccctccggagcgatattaaaccatgaatccctgcagctggttgctgatatctgtcaggatcatgacctcattgtcctctccgacgagatatatgagaaactgatctatgggaaaatccacacttctatcggggcattcccagggatggaggatcggaccattacggtgaatggattctcaaaggcctatgctatgaccggatggagacttgggtatgccgtcgcatccaaagagatcatcgggaacatgaacaaggtccaacagcataccatctcccatccgacgacctttgcgatgtatggcggggtagcagcactcaaagggccgcaggagtgtattgaggagatgcggacagaatttgagagaagacgtgcctttgttctgaaaagcatggatgagatgggcctttcgtatgcaccggcagacggggcgttttacgcctatgtcaaggtcgacggggatgatgcagaggttgcgaaccgctggctggagaagggtcatgtcgctgtcacccatggatctgcgttcaatcatccgggatgggttcggttaagttatgcagcgtcaatggaccggttacaagaagcgatgaggagaatctctgctgttctctaattaaaaatcagatggtaacctggtaggttacattcctggtggtatagagccagtatccctgccagggtaccagtatccggctatcactctggttcccggttccattccgtaaaatgggctcatcgtacatttgagattgggcatcatacccaatcacataggtccagttatctcccaaaggaatcagattggtttttgctgattcatatccggttccaacgactccaaacccgttccagccattttccatatctctggtgtatgttccgctttgatttggatctgattttggggtgatattctgactctctcctgaatatatccagtatgatgagagcggggcaatcttctcttctgccgggactgttgtccagtttgcatgtgcgtatttcagaaccgaatgtccggaggtgttggtgatctgtccaaagaggtcgaaggcggtgtcattgccagctttcagcctttttgtaatggaaacatggttccatcctggatacagggatatctggtccggttctggttcaggttttttcaggaatgcaagagctgcagacagatttgcccgcccaccagatactgtaatatttgcgagattgggaattggatcagcagttttcagtatggcctcctttattgtctgatatgagacatcaggagcatatgtcgccataagacctgccattccgctgacaaacggtgcagccatggatgtaccgtccatatacccatatctggtctctacaagatctccatacccttctgaaagggtgatatcatcgaggaaacacatgacaaaggtgccatccgcaccgaacctgatatacagaggtgcgttcatcatatctgatggaattttacactcccggtagatccagggaagaacggtcaatggttttgtgtcatactccagttttttccaggtcagattatcattggaagcttcaatatagaatgtggagtatgcccccaccatctggagctgataggagattatcggttctgtcaggttaaaaatgtcaaggggttcttttaatgagatgataacaggtggctctgtctggttcaagacggtattgtttaccaatccggaggcactagatggtggagaggagaaattctcagtattgagcgtccaatttccgtgaatcgtccagttgtttaatgtttcgaatgaatcacgccaaaccgggtctggtttatagatattgtgtttggtagaatagatatctgctcctggtgctccgatatcaactgatacttttccgaagtttgaaaatgaagccaattcgtcatgggcattcgtcgctgccacagaaataatattgtcaaggtcataacttgacgggtaatgaggctcaaaatcattatcctgcccaatgtttcctgctgcacagatgaaaagcccctctgttccggcaatgacctcatactcggcttggctgaaatcagagcccccatatgaacatgaaaaaatttgagcaccgtttcgtgcagcccataatattgcttctatctcatccgatactgttcctgtcccgaaactgttcaggaacctgaccgggaggatggtagcattccagtttactcctgaacctccctttccgttatttccgacagctcctatgattccggcacaatgtgtcccatgtgaggcaaggtccatgggttctaatgtcccggttatggcatcatacccatgtgttccggtcaggggatttgtccagatattatctgccagatcctcatggaggtaatcaacacctgaatccaggacggcaatgatgacatccgaattcgtggttgtattccaggcagatgctgcttgaatatctgctccgggtgttcctggtgcaaaatcttctttatatacttgtcctgtgttcacaagtccccattgtctccagagatccggatcgtcagggatgattgctgatgtccggtaataatccggttctgcgtattgaatcccggattttaccgagtagtatgcaaccccgtccgtcacactcattccttcaggaagtgcaactagttgcagacctggggcacccgaagcagaaaaatcctcgagcactctggcacctattgttgcgtgagctgaagagagaactgaagcggtatcttcagcaggaccgtctgcccggaccaggaggacacctggttgatatgaatcctgaagatcctgaggttttatttcatcgaaattgaaaggcattaccggaattgcagtaccagcctgtatgaaaatactaagaagaaccagcacaaaaacctttgaaaaaaaaagtttcatccatccaatcccatctttcatcgtttgatcacctgatactaggagattatgcggccccttataagtatgtgacgtttcagatagtatttagggattttcacgtaccggtagaggatatgtatgcgaagtctggtatatatcctgaaacggattcaaaccagagagtttttgaatgatgagtaaagcggggaaaccgaaaatacatatctctatctgacagatctcatcttatgaagattctgctgctgattgtaaccggccttctttttctcatggtctccgtagcagcggaatctggctctcttgagatcaccgctgacattccatcagttccggtttatattgataatgaatatgcaggactttcaccggtacacgtttcagagattttggagggttatcacctgattcgggcttctccggaagggttcttctctcagacacagaatatctctgttgaggctggtgaattaacatatgtttccttttcttttctcaatagtgacaagatcccaatgcctgcgctggtccggattggcgaatgtgtgggaacacctgagccctctgatctggatggaactgcctatgatatcatccgtctgcctgatggatcccttatggcgtattatagcgggtgggaagaaggaatcatgtgcatggagtcaactgatgggatctcctgggaacggatgagtgagccttgtcttggtgttccgacgagaggaagtgttttcagaaccgaaccatgggtctttgcccttcctgacgggacataccggatggtgtttcgccagacagtcggtcatcaacattcactgtatttgggtacttctcaggacgggatatctttctccggggaggaacagatacccattgatggtgaggatactcagggcaattcaggatatccatctgtcccaaccgggataacctatgatgacggaactgtcaggatgtactacagcatccctggttccgggataaaaagtgcaatatctgatgatatgggtatttcctggaagaaggaggatggtatcaggatccgatatgggaccgaccctgcggtcatgatccttccggacgggagaactggtattttttatgttgatacgactccaaagtctaaaggtcagcggatattcttctctctctctgaagatggcctaaatttttcaggattacctgtgcaggtacttgagacgatggaacccggcgtctggctgatggatcctgaaatcatcagtgaagatgatacaacctacctgtacttctcagtcatgggaatggaaggtatgcagcatcataccctgcctggtacacttcggagtgttattgatatgggatgcctgagcaggcaggtatcatagacaacaaaaacgaattcttatttttaattatcaaaaaaatggacccggcgggatttgaacccgcggcctctgcgttgcgaacacagcgatctcccactgatctacgagcccgaaatggagatcagagaatgatctcaatatccagtttttctgccagttccttataccggttcctgatggtaacttctgtcacacctgcaacctctgcaacttcacgctgggttctgcgttcaccgccaaggatggaagagatgtagatggcagctgcagcaacaccggttggtcctcgtcctgaggtcagctcccgttctcctgcctgcctgagaatctcaacagctctgctctgaacttcacctttcagctggagcccggaacagaaccggggaacataatctatcggcgaggtcggcaggagttttaatccaagttcacgggatatgaaccggtatgtacggccgatctcctttcttgatactcgtgatacttctgcaatctcatcaagtgtccggggaacactgcactgacgacaggcagcatataatgcggctgctgcaaccccttcaatactccggccacgaataaggtttttatcgacggcatcacggtagacaacggcagccgtctccctgacattgcggggaagaccaagtgctgaagccatccggtccagttcagacaatgcaaaagcaaggttccgttcggttgcattacttaccctgatacgccgctgccatttcctgagccggtagagctgtgcacggttcttggatgagatagcccttccataactgtcccggtttctccagtcaatcatggtggagagacctttgtcatggatggtaaaggtcatcggtgctccgacacgggaccttttcatccgctggtcatggtcaaaagcacgccattcgggcccgcggtcgataaattctgcatcaataaccagaccacactgctgacataccagttcagcccgttcataatcatgaacgagttgtctgctgccacactctggacattgagattcggtctggttctcaatcttcttctgtttctcagttaccttcccggtcagcctgtttttcagggcttcacgttccttctgaagggtccggagtttctcaatctcttctgacattctttcctctatttgataaagagcttctcgccgatgagtcgcgaaggctcctcgatattggtcaataccgcagcgtacggtgatgtgacattaccgaaaatatcgataagtttccccactggtttccaacgtttatcaagaactttgctgtacaggcggggaagctttgctgcatcacattcaacgataaggatgtgatgtccaaatttacttttgactcttccaatagcccgtaccaatacatcgcccccaaaaatgcctgtatccccccaccggagataagataagcaacctatatatgtgcgaataagatctatttaatatttatgacaattattaagtattacgtaaaccggttaaaaaactcatttccctctgtagagagaaggcttttaagtgattcactagatattccagcacctgcggcaatgatctcacggtctcgtcctgacatcagatcacccggatgatgtgcatctgaatccacaaccataagacatccggtcttttctgcaatcctggcaacatggccgttggtccggttatgccccccccgagcggtgatctccagggcgatattgtgttttctggcaagggttgcatcctcttccgtgatgagacctgggtgggcaagaatatcaacgtgaggacaggagagggcagcatgatttgttcctggcatcactggttccaccggagattcaccatgtaccaccacaatgtctgccccgttctcttttgcatatctggccagatccggaatttctaccggtgggacgtgggttatctcaactcccctgagcagtttaattcccatagtatgggcagattttgccacccggcctaatgatacgagtgtctcgtctatatttccggcatcaacatgatcggtaatcccgacgacggtgtatccaaggacctgcatccgtctgagcagttcagtcggaaggaggtccccgtctgacaggagtgtatgggtgtgaaaatcgtacatatcagttcttttttcctccggttttcaatccggaactgacaagtgcgatcagttcacccttcgatcccggatattcgacgacaaatcttccctgatgtttccaccagtatgccgggtggcattttgactcacgggtaaaaggaattttatttgcttttaaaatacgttcgatatccccgggttcaggatgagcgacgccggtgtcatgggagactctgcgcccctctgaccgcatcagctcactgtcaaagtaacagggatagagttttactcccttatccattctcacagatctgcaatctgaacctataaagtaccagcgggagagatgctatggtatgcatcatatcgatatctccattgaaaaagatattttttcagcgaaccgaaaactggctgatgcaaatgccgcgcatcttcatgcccatggagtcagggcctttgatctgctcgggggcatcggttcaggaaagacggcactcatcgagaaggtcgttccaaaactgaagagcagaggactgaaagcagcagcgatcgcaggagatgtatatggcgatgatgattttcagaggattgtggctcttggcattcctgctgaaaatgtgaacaccggaaaggagtgtcatcttgatgcccatatgatcgaacatgctctggatcatcttccgctcgatgatgtggatgtcctgtttattgagaatgttggaaatatggtatgtccgactgattttgagctgggcgcggagaaacggattgttgttgtctcatccactgagggcgatgatgtagtcaacaagcatccgatgatgtttcggggctgcacgattgctgtcctgaataaaattgatcttgccgatgcggttggtgcagacctgaaccggatggaacgggacatgctcaggtacaatccagctatgaagatattcaggacgaatatgaagactggcgatgggattgatcccctggttgatgagatcctgtcctaggcggaatcttatatactggcgcgggggatatgtataagactccgtggtttacccggctctcccactccgggtaaatgatacttgaggatgagatattatgcaatggcaaggacgttctgttcggaaatccaccggcggcaggtacagcccgtcccgtggaaaaagacgcagggagatagggtcagccccggctgaaacccatattggtattgaccggagaaaaatttcccgtacctacggtggaaataacaaggtccgggcactccggtgtgaatatgctgcaatcagcaatgcaaagaccggagagacgaagaaagtaaagattgagactgtggaagagaatgcagcaaacccgaactatgtccggcgtaaccttctcacccgcggtgcaatcatcagaactgaacttggccgtgcacggattaccagcagaccaggtcagcatggcgttatcaacgctgttctgatcgaataactcttttttaaaaaggtttcaggtgggttttacctgaaaatcagtatatccataataactgacaggaatctcccagacaaatatgccctgatcatccggaataacggtggcaagatactgatactcggcagctcctgtcatacgcccgaagatattaacaggtgctcttagatttcctgcagataaaaatcccacgagtgatggttttttaccagttgagagatctccggggtatatcgagaatgatatgttctgttcctggtttacaaaaggctccggaattccaccttcataggtgtttacaacggcaggaatactcactccctgagccgatgtaaaaagtcctgggtgatacccgggggctgaagaagggacacctccggtatctgccagaacgctgctgactgaaatggtgccaatccccaccagcacacaaatcagcagcatataataatgcgatctgatttctccattcatctgactcacatctccatccgcttatgcagtatgtgtaccaccaatattctcttgtgtagataaaaagaatgggatggaagtattatctgtccaatccgtgggaattttaaatcaatgaaaaaagaatgatgagttaaggaatctaacataaagtacaggatttctcacccccggtactctgacatgacactgaaaaccgcactcgcagcacccttttatcatagcagggctcaaaagcttggaaaaagcgaattaatttactattatgcctttgaccgccggtggatggatcgtgaacaggttgatctcctgattcaccggggcgtagagcagcatcttctcggaacagatggagagatgtattatcctctcttcgatctcgcagaggtccagattcctatcgggtataaaccatcatcatctatttttgatgcgcatgatccctttgaacagctcctggaccgtatcaccagtcatacccggaaagaaccggaggagatcattgcccggatgaatcaggtgataaccgaagactttgatggaaatataagacctgaagcagcactagttattgttgcaaaaagaaatcacatcccagttgccgatctgctggatccgctcaagcaggtactgctgaaaaaagattaaaatatttattctgctgccggtgcttctggctctgccggagcaaagtattctgcaagagtctttgaaccctgggttgcgacgatcgcattaatctgaacaaagtcctgggtgatctctgcaccacggaccattttcctccgacgctcgccatctacacgtgggtgaaatccgacaccgcctgccatgaggaccttacgccgtccggcaatctggagggtctttcttgccggggttccgttccggtcagatgcaccggtgatccggatcttgtatccgtcaaacccaagtgcagcaccatcaatctcctcaccgatacgcttgccaataaaagagccggcacctgcaccactggcatcaatattgtatgccttgccggttgccggatctgaaaggactaccttaaaatcaaccattataatcacctactaagaaattcaacgaccgctgttttttttatttttcgtccgatccgaagaacccatcactcagacatcgctgagaagtctccatacaggttggtatatatccttaataattctacttcccccagaagggattctccttacgaaagagccgggtgtattcattcagcacttcctttgcatcttcgttcaggtgagagagcatttcagtctccagaacttttacgtgccgttccggaatgcccacaagcagttcatcctcaacgtcaaattgtctgccaaccgtggcaccttcaatggaaattgcaacctcatctccggcatgtgcctcctggatgttttccttcctcagttgcatagatttgagcgttccggcctttttaccatctcttctgaccagattcacaccggtcctgagagttcctgagaggattctgaccccgaccactgcaggattattctgcctgaagacacatccgggaagaacaaggattttagcggggaagattattttttcaaaccgcttctggtccattatcctcttaagattattcctccattccaggtaatcctcaagaatatgatagataacattccctgagaagaactggatcatctctgcataggctggttctttcaggagatcctgggcgtcaggaaggaccggggtgttgaatgcgattaataccctgtaaaggggatcttttatcgtttcagcctcgataacatcatgcctgctgacctggccaacctcagcccgcatgaccggtatttcatgcgcggtcagctccttacatagtgcctcaagcgccccaatggtatctgcctttatgatcagaccttccggagagagactgacatttatttcggtcatctctttcgcaatactggtcttcacctcttcaggatcttcaccgataacccgcaccggagatccggcaatgacctggtcaagtcctggggcactaaccttcactcccgctgcggcgacgacctcttttacccgtaagaaccggtcttcaaccaggatctcctgcattggtcttggttgaagaagagatctgacctttgtcgtctgaaccccctctgtggttgcgattgctatttcgtcaccgacccgaatggtcccgtcaaataatatgacgtcgattgtggcaccaagacccttctcttccttcacttcaaggacggttcctgatccaggtccgtcaacagtaagagtcagggcttcctccatgtaccgctgtgcaagaccaatgagaaccatcagaaggtctggaattccttcaccggtatgggcactgaccgggacaatcgccaggtttcttgcgaaatcagatacccggtcaaaccgttctgatgagaatccatgctcggcaagagtggcaacgatgtcatagacctttgtctcaacgaggagagttacccgttcattctgtgccgcaaaactcttcaggaacggagatttttctgtggatctccatccaggaatccggtcaagtttggttgcagcgaccacaaacggggtcttgcaattgcggaggatctggatcgcctcgatagtctgaggctgaaatccctcggtaatatccacaaccacgatggccatatcagcaagtgcacctccccgtgcccgaagggtggtgaatgcatgatgccccggcgtatcaataaagaggagtccgggaatgctgatattcagatttttcattccaccactcatgctcataatcgaatctatcgggacaatggttgcaccgatatgctgggtgattgctcctgcctctccggcgacgactgaggatcccctgatccggtcaagaagagatgtcttcccatgatccacatgcccgaggacgcagacaattggagtcctgatatggggtgtatctccttcgtttttatttttctttacttcttttttacccacctttccaccaccacacctattctgttgtccattcccggtgctatttgaaaacaggagatatccttccgggaagaggatctgataatgtggtatacatcagtggtcacgactaataatcattcacagtacctctcagggacggtcattcatactgacagcaatctcgatacgtcagagtcagggagtggataagttcaagtcatctccctgataacatatatggtgcaacctgcctgggtggggtaatggctatcctaagggattgtggttccctcgatctgggttcaattcccggtccaggcctgtccgtttttattcagtaattctgctatttcttctgatattctggtttaatactaccgtctctgttcctggcatctgaaatcaaccgctctctccgataattttcttaataccccggtcaatatcatggtatggaccagagcgaagagtatcacgaagctaaaaggaaagtcacaaaactcaggggattttatcagcatcttggcttttatatcatcatgaatgccattctcatagtaataaatttaataataagcccggacagtctgtggttttactgggtgaccatcttctggggaatcgctgtgctatggcaggcgtatgatgtctttggagatgagaagatcctcggaaaagattgggaggagaagaagattcaggaatatatgggaaagaaaaagtgaaccccgcggttactgaaaccctcctgcaacccatccggtatacccgccggccacattgaggatgtttgaaaaaccgtttctcttcaggatactacaggccatggaagatctcgccccagttgcacacagaacggcgatccgcttctccctggatagttctgagtaccgggtccggagatcaggccagtggatattcacggatccgggaatatgatacccggcaaactctgcccccgttctcacatccaaaacaataagctccttatcagccttcaataacgcagcaagttcctgaacagaaatcgtctggacgtggtccagttcatgtccggccagagcccatccccacactcctccctctacatacccgatgatccggtcaatacctacccggtgaagcataagggttatttttgggatctcatcaggacgatgaacagcgagcagaatatctctgtcaggagggattacccacccggtgaatgttgaaaagttcatctcaccatcgatattccagctcttcgggatatgaagagacccgaaggcatcgtatcgtctggaatcaagcacttcacatgccccctgtgtcatgagatcctttcctgcccgtgggctgattcccctgacaggaggtaaagttgagagaagagcagggccccttcgattctcatcagaacaccggctgaagtgatccggagaggggggcatatttttcgtaagttcattgatgaatgcctctttatcgtgaatctggagtatctggttaaacctccgttcatagccgatggttgtcgtccgtttagcggataatgatcttccacagaatgatccggctccatgagcgggatagacctcacaataatccggcagtttcatgatcttctcatgcagggagtcatacaatgctgatgcaagctcatgggcacgtccgggaaaaagatccggccttcctacatcaccgacaaagagggtatcaccgggaaaaagagcagccggttcatctcctctgctcatatgggtgacaatataactgacatgctccggtgtgtggcctggtgtctcaatgacagagatggaacaatcatcaagggtaatggtacttccctcactgacaggaatatggggaaatacacatccggcactctttggagcatagattggtgcaccggttctttcatggagatcgaggtgacctgatatgaaatctgcatgcagatgtgtctcaagaatcccggtaattctaaatccttcttcatcagcagcctgaatgtagatatccggatccctggctggatcgatgatcatgcaggaggaaaccccgcccagaaggtatgagctgtgagcgatccccggaatgaaaaactgcctgataatcatgaagagatgatcatctcaggaagtgatgaatcattcccccatctcgtatgaccagccggtcctgcagggtttttgggatctggtacagggagcatactcctttgtttatctcctcttctatctgctgaatttttttcctgattctctccttgtcatgaaaggatctggcacattcacgtctctgtttaagaaaggtcagcctatgtaaagatttggtaatctgcctgacatgctccatctcttcaggggaataccagtctggctgatgaaacgggatagcagcgatgagttgttccggatggagagaaggctggtttttacttatatacctgtagtaccacctgatcagggatgatccaagcagaccttcaaggtattcatccgggccctttatgatgatatctgcagcgttctcataagtatctcctgcggtaatcagcagaccatccgaagtgtcttttagtgatatccagcacccgtcatggttgtgttcagacaggtcttctggtgtatagagagctccaagacagtactcagagagtgataccgaatctttcaggagataactcagaacgacgctctccaatggatcttcaaggttccagccatcttcttttggcagatcatcccggttcagatgatatgataccatacatccgttattggtaaaccgggtgatcccgattgatgacgaaatatttcctgcacagatgcatgaccatgtatcagacaggtcccgttccgatggatgttcatccaggatgatctgagtcactctgcttctccggatcatcttcctgaatggtcccgcatgcatatcagaaagccatgctgacgggagaaaaataaatgagcggtgttgcattctgattgcatattcagcagtatacaatgcagtcatcgcatcataggaataagatgaaaagtgtttacacaggtactggtgtacttccggatctttcatggctttttgtctgcatggagcggtgatgagcatggcaggacgaggtatgttttccagccaatcttcatcagatggtctcagcgaatgaacggctgcctgtgcctcgtgcactgagagatattcatttgcaatctctttggaaaagaggatatttccaaccctgatatgtgaccggaacatatccagctgttctttctcacagagctgaaagaggtccgggtgccgtaaatcaccatcgattgcatggagtatcagcccgaacctggtcagcagaactgaagaaaacgagggatctgaacagaagacagtatctgcaattctgctgaaccgatcacggggagaatcctcttttccggtatgtgatctgagaagaagaagcaataattcaccattgcccgattgcggatcaatgacaaccggagttccctctgattcgtttatgtaccggattacatggaaaaagaccggtgatgatataagagatgagatatcgcagttactggcaatataatccttctttcgcgtgttccgatctctgacccgcgttatcagacggctgaacgcacgaacgagaatgaccgggtctatgagatatatccggatgggctcaggaaccgggagagagcacccttctcttaccatcatggaatgagttaccggatcaggtaagtaaggaggtttgtctttcagatagcctgggatcgcagatccacatttcacaagataactgatccaggaatgttccgggaccgtgtaaaaatcaatgccactgctttcgaaaattttctttgtaacggtttccagaatgccggaaaggaccaggagttcacgtctctcccgatcactctctccataggtcctgtaaaaaacccctgacaatgtcctgtgtaaagcatccagatatgtgtccagagattcagaaatatcagcagattcacagagtattcctgtttggatgagttcaggaaggggctctattatgttggaatattccgggtctcttgtctgcccgtttattacctggctaatggtactactgataattcgatatcctgcacaggcacctgtatttttcaggtgaattatgagttctttttttatctcatcactgatatcagactctttggaacaatcccagatgataacctgacggagatcatccagggtgacataaaaacaggatatactgtgattataatctttgatgatgagatttctctttctcagggaacagatattatctaaaaagcctgccttcctgattacctgaatgcaatcctggtgaatgtcaggaatcatacgaagaatacctgaaaagaagtatagcgagggatggatttgaaccatcggtctacgggttatgagcccgtcgggatatcctgactaccccacctcgctaaaagtggatatgaatgtctctcggatgaagatatatatctatcgcttctctgatgcgaatttttaaaccaacaccaagccaatcatcacctatggatgaggaacttgagcggttacgggcaaaaagaatggaggagatcaaacagcgcataatgaccccgccatcggcccatgaaggaattcttatcgtcacgcaggaaaatttttccaggataatccgtgaaaacccgaatcttatcattgatttctgggctccctggtgtggcccctgccggatgcttgctccggttatcgaacagctggcggcagaatatgccggaagaatccggtttgccaaatgtaataccgatgaaaatcagcagattgcatatcagtttggaatatcagctataccatccctgtttttctttcagaatggtacgattattcatacagtttcaggagctcttccaaaagaacatcttgagatgcagattcgttcggtgtatactattcaagccccccaccggagtgattagggtatactatgacaatgaatcatagaagcttgtttactgatttctaccttccaacaggaactgaaacgcttttacagcatcgatcaacccatatccataggttgggtcccagccaggttctcccaggtcaaacgcatttgaatacaatgctttcaagaggtcatcccgtgacacatcaggaaaagagctcaataattgtgcgatgactccggcaacatggggtgctgcggcacttgtaccggggaatggaaccggaaaacttccggcaccgctgacctgtacatttgtcggtgcacagatatccggtttccaccgtctggatggttcaggtatccggatagtaaccggcccctgggatgaatccggtgagacagaatacggtgttccaatcccgactgatcctaccgttaccacttcttctagtgccgcgtggccaaaaatggaatctactggatcctttacgacctctgattcaacctggcgtggatcgatattcctgatatacatttcaagaatattcggtgtgatattttcaccgttccgtataattgacaatgatatccgcctggattcgttcatctcatttctgtagaccagatgttcaaacggttctccggtatcttcctgaatattcatactcgttgcaacgacctcaccctttgcaggatcggtgaggaagaggtcatagtcatgaaccgcacctccccatgggtcatcccactgtaaggtaattataacctcgtcatcaggtttgaggacaataggaattgcagagtatccatcaccaaagtcatggaccgtctgctctggtccgatacttaaacccggttcccaggacttctgataatgaagtgaggcaaaattgcctgaaacggtaacatagatgcaatccggatgagatttcaagacctccctgatatgatctgcaacgtcaccatcttcgagaaatggctgcttgaaaaaatagaggtcatcacagatgatccggcatccggcagcagccagtgttgaaactgctcgtttaaaatcgtctgaatttcctccatacgcatgaaaacagagttctgcatcaggtgcaatgtcatggatgatctcaagcattgccgtcccttcatctccagtccctctctcatacagggttaccggtcccagttctcccatcttttgggacagttccagggactctgctccgtttccgatgactccaactttgataccttttcctgatgcaccgaatacttctcgaataccattacttctgaccagaagatccccttcggtctgcaaagatccaacgcaggatactatggttgagttatcagaagataatgtcagggatgtagtatctgtcttcatagcgcatgagctcaggcagatatacccaagtaccacacacaaaacaagtaccttcatgcaccccatttgacagatccccccggatctgaagaccagacaggagcccctcttcaggacgctttcctgtttgatgagctatgtatccatgaaatataaggttctcagagtcctccctctggtcaatcaaatcttctattatctggcctgacgaatactgatatgttcaatatgcagatttatgtgtttcagagttctagaatttggttttcattattttgtatctgtatgtgttgtcttctgtttcccgctgcaatggcggaagagaagacaggatattttgaagtgacatcagttcctgagggggcagatgtctttatcggctcacagtttatgggagaaactccggttctgatacctgcccgtaatcagacagatggaacacggatccgggttatgatgcagggatttgagatatgggaacagaatattgcaggaacccctgctgccggtcaggtagttcccataaaggtctcattaatcccgatctctccatttggaacacttgaagttacatcttctccttcaggagctttagtcacggtggataatggcatgggtcagatgactccctggacttaccgggatatcagtaccgggacacatctggtctctctttttctctccggatttgagccgtatgtggtcaatattgatgttcttcccggccaggtaaccaggcttcatgcgaatatgacgatccgttccggagcgggatccctgcaggtcagtacaacccccggtggagcatcggtgtatgtggacggggttttttccgggaccacgaacacagtgataggaaatatcccgcctggaaaacgccgtgtccatattacgagggcggggtttgaagattatgagcaatgggtagtggtcagtaaccgtcaggtaacagtaattgaaactgccttaaagccggtgacaaaaacatctgacggagcacttgtcatcacatcagatcctcccggagcctcagtatttgtggatgatcagttcagaggaacgacagagaccggcaggccgcttgaactgaccggtatgagtccgggccagcacaaagtttacatgagtatcagaaattacgaggactactcaacaatggttgatatacgggcaggtgaggtaacgccggtttcagccagactgaacccgagccccatgccccaggactgtggaaaacttatcctgaataccgaaccggcaggcgcagaggtatatattgacggttcacttgttggggttacgccggcaaccatagacacagtctgcacagggaaacatacttaccggttgttccttgcaggataccacgactactcatcacaggtagaactgatccctggtcaggttctgcaggtaaatactgtcctcacgcccgaaccggaaaaggcagaagggactccgggaccggcgattccagtgatcatcgcagttctggctcttgtactggtcatcttctcaagaagagtatgaacagatcccttctccttctttccgtgatgatatataccgtgccgggcaatatgtagagagtttagatcagggcatgggatatgaggaaaatatcgactcctcattacacctgaaatatcggagtttttcatgcaggataatccatctattcagtttgatgatcaaagactggcgaaacgtcagcaactcatcgaggccggggtaccgatgtaccctcatgagttcaggcgttcacacacaatagcagaaatcagagcaaaatattcacaagcagggcatgatccgtcatcagatcaggtgatcacggcaggccggttatatggtgtgcgggatcatggaaagacgttttttgcagacctccgtgatgagactggaagaattcagttgtatatccgcaaggacgctcttcctgaagggaaattccagatgtttaaatcctcaattgagaggggggacatcatcggggtaaccgggagaattttcaagactaaggtaggggagatttccatttttgtcgatgatattatccttcttaccaagacactctgctccctgccggagaagtttcatggtctgaccaatcttgagaaacggtaccggcagcggtatttggacctcatcgtcaatgaagagagccgggagacattcaggacacggagcaggatcatatcgctgctgagaaattaccttaccgggcagggatttcttgagtttgagaccccgactctccagcccctctatggaggagcaaatgcacggcccttcacaacttttcataatttccttggccagaaactctatctccggatcgctcccgaattatacctgaaaagactggttgtaggtggctttgagaaagtcttcgaggttgcgaaaaacttcagaaatgaggacattgataccagtcataacccggaattctctatggttgagatataccaggcatatgctgattacactgatatgatgaaactgaccgaaggtattatcagcagcattgtccacgaagtgaccgggtcatatgaggtggcatttgaagaaaataccatttcatacaaagcaccctggacggtcatgagcatggaagaggctgtgaggaccattgggaaggttgatatctttgctcatgatctggagagtctgaaaaagatcgggaaagagaaaggcgttgatggtattgacgatgtccacacacaacgtgagatgctggtcctctttttcgaagctcttgtcgaggataaactgatacaaccgaccttcatcaccgactttcctgttgaaaactcaccactggcaaagtctcatcgggaaaaagagggatttgtcgaacggtttgaactgttcattgccggaatggagcttgccaacgggttctccgagctgaatgatcccctggatcagatggaacggtttgaggctcaggaagagaagcggaggcttggtgatgaagaggcccagatgcatgattacgattttgtcaatgctcttgggtatggcatgccaccgacgggaggtgtcgggattggtattgaccggcttgttatgctgataacaggaaatacctcaatcaaggaggtgatcctcttcccatccatgaagcgggaagttaccactccggctgacgaagaggaaccatcgtctgtttaagatgaatgtaaaggaaaaattttatccattatcttttatttcacaaagcatttcaaatctgcaaatctttttgttcgcaccacctgttttgcatgctctttaattctgcataaacgcaccgatgctctaatattttttagaaaatattatacgtcaataaaaaatatccttgtcatattgtacatggcataaaactggtgtcttacgggagaactgaccctgcataatccagtgtttttatctgaggcgggattctcggataaatgctgaattaaaagaatatgcaggagttttaccatggggtcaattatggacttgggggttaggatgcgatgaaccggaacatatctaaaggagtgcttgctgcgctcttatgtattctcttatgctgcattgtgatggcagataatcaggaaataaattatactgatatttctgcacatccggtgcagtttatcgaaaatgccggacaggcacacgaagatattctgtatcaggtgaaaagttctgaattttcatttgattttaccaaagatgctcttctggtaagtggtccgtccggtgactgtgaggagtgtggagagaatgtcactactccggtgattgtaacagttgcagatgctgaagagaacgtcaccgttgaggcatttgacaaacttgatggatatgcaaacttcctcatcgggaagaatgagtcagactggcagcagtatgttccctggtatgggggcatccggtatcgcgaaatacttcctggaattgatctctcctattccggaaagcagggtgttctcaaacgggagttcaccgtccgggaaggcgccgatcccaatgccatccgactcatttatggaggaaacgaggggttatcgctcacagaagatggttccctgcaggtagttacgtcgtttggtaatctgaccgaacggtctccttattcttatcagataattgaaggcaatactattgaggttgagtcttcataccagatttttgaaaatggtgaggtcgggtatactattggagaatatgatcctgcctatccgcttataattgatccgtacctagaatattccaccttgcttgggggaaatctcgaagattatggtatggatattgccagggattcttcgggggatgtgtatgtgaccggatatacgtcgtcgtgtaattttccgttacgagatccaacggtcattaatactgcatatcttaaatttaatggttcatattgtcataacagtcgggatgcattcataacgaaaattgggatcaaccagacaactggaaatgcatccatcatattttcaacgtatctgggtggagataaggcagactttggcaggggaatagcagttgactccctgaagaatatttacgtgactggagacacattctctgaagactttccaataatgcttccgtttgcctatggtgacaggcttcatgggtcaaatgatgcatttgttataaaattggatccgaccggcacaattatcagatggtctgattatcttggaggaaattttgccgatcaggcgaatgatatcgcccttgacagtctgaatgcggtgtatctgactggtcagacggttgggaacagtccttacaagaaactggaacaggtcttcccaacaaccccgaatgcgtatcagactgcaccaaatccggatgctgtgatgggtgatgcatttgcagtaaaaatcagcccgactggtcaggttctggaatactctacatatatttcaggttccgggcaggactatggaaatggtattgcggttgacggtcagggcatggcatatatcaccggaacaacaagttcaacaaatctgctccctaccggagtcccagggtatcaaaaatccatcaagggagggcaggatgcattcctctttaaaatgaacttccaggcaggcattccgccaatctacgcgacttatctgggtggatcaaccgggtatgactatggtgaagcggttgctgttgactctgcaggaagtgcatatgttaccggagcgacagcctctactgatttcccagtcacgaatatggcattacagacggtaaaggggtggccatatgatgcatttgagaaagatgcatatgtaacgaaatttggttctgatggaactggccttatctattctacctatctcggaggaagtatggatgactggggatatgatatcaaagttgattcctcattccgtgcgtttgtcactggttatagtcgctcatcccagatcccccggagtggactcatcaataccattaaacaggcatctggtggtcaggacggattcctgacggtgattaagagtgacggccgctctgctgagtcatcaaccctgttcggagggtaccgcgatgatgtcagcaggggtgttgcgatatctcctgatggaaataccagttttgttaccggatacaccagttctccaacaatgcttaacctggtatgcggaagcgattgtgaacgggaagcattccctgtgtacaagtggattaaccagacggtttatggtgacagactctatattggggggaactttagtggagattttcagggcagctttgatgcctttgtcatgaaattcggacagccatcacttgttccttcatttagtgccagccctgtttgtgggacgggagagcctaatctgactgtaactttcactgaaacgacaaccggttcaggaaatattctgaacaggatatggaactttggtgatggcactccggtaaatgataccggagcaataccgatggtggtaagccataattatactagtccagggacgtaccaggcaaccttaacactctatacatatacgagtatactcgtgagcgatccggttagtattaccttctgtaatccatatacaagtgcaaacttcaccgtagcagggtataataacacagcggatccgattgatgtacctataaacacagacataactttcagtggatatgcagtgaattacacgcccacttcctataattggcatttcgctgatggttctgcaaaccaaacagggcagacgactcatcacctgttctctcagcagggaacatacacggtaaatatgaccgctccttcgggaacctgttgtgataataatacgaatatcgtcggttcaaaacggattcgggttctcgctcctccgttagcaaggtttgtgaatagtacaaccactccacgaatcgggtgtcttccacttaccgtgacctttaatgatacttcccctgtcggtacagttgattatggggttcccaccgcatggcagtggaattttggcgataactcttggaatggtactacccagaacgtaacccatacctatcagcatgctggaacatacacagttagtctgacagcatcaaatgctgctggttccaatacgtacacccagcctggttatgttctggttagtggaaatgtgactgccgggtttacggcttcacccagagctggcacagctccactgggtgttcagtttactgatacctctgcgggagtgccaacatcctgggattggagatttggtgatggtggttcgaatacctctcaaaacccctatcatgtatataacaccgccgggacatacacggtgaaccttaccgttactaatgattgtggtcatgtcgcgagtgcgaattatactgattggataaccgtcaatggaaacatgacacccaaaatattatttgggaatagcacgtttcccccgacatcagaaaatccggttaatggcactccggttcttaatgtcacgttccttggtaataccactgatggcacgctgattgattcagccgtatggagttttggcgattcgaatacaacaactcagaccagagcagccgggtggccggctgataatacctggttcaatacatcacacaaatactacacggtcagagattacacgccagtgttgcagattaccaatactacttatggttccggaacaactggtgggttgtataccgactggataggtgtataccccccgatcattgtgaactttagtgcaaccccgccctcggggattgtcggacagagtatcctgtttactgatcaatcttcaggttctccagtcaattggaactggcatttcactgatggcagtcagaatgtctcagggctgtcatctgtgagtcatgtattcaattctactgcagtgtggaatgtcatgttggaagtctggaataagtatggggcaaccggaatcgggtatcggtatgtaaatattacatctgcagattcatctggtcaggtttacttcattcctcaaaatattactcttattactgaggatctcaactaccgggttctgaatgttgttttaagtaaagcagactacgggctttcttcgtatacgataaaaatcgatctgaataattcagcacgggcacatatccggaactgggcaacatctccatcatgggtagatcatttcacgtattcagtaagtccggcgtttgattcgattaccttgtcagggtataaggatagtggaatgcttccagccggttccagaaatatatcattaggaaatatcagtctgactggaatttctgcaggagatgcagatttgaggctgaatggaacatcgattgctcagtatggttcttcttttatgtctttgacaggagtccctgctgatattcacgtatatgctgtcagtcctctccctggatactccaataagcctgctgatatctggcctcctggtgtgcatgacggactcatcgatgactttgacggcaacggggttgtaaacaccgcagatgttaccgtgttctttaacacctgggtttcaggaggatttaccggcatgccggttccgccatttgactataatcacaacaaccggattgataccgatgatattgttgagtatttcaatctcatctggtaacctttcatttcaggtgatctcatgaaaaacaaattccttacaagcattctgaccatatgtatggtttcattgttcctttgtggaacagtatgtgctgataaggtatcccttgaggatatcggaatcagtaccgtcggacaaaaagttgaacttcccgttcttctggattcagctcctggaggaattgccggttataaatttaccacgtcatttgctccagccgggattgcacaggtatcttcagtaaccatgcctgaatgggctggaattaaagttgtagaaggagcacctggtgaaaaggtgttagtatctgcattggatcttgagatgaaggttgaggctgggacagggcaggtacaaatctgtacacttggcattgaaggattgtctgagggtgtcgcaacccttacactcaatatcaccgaaatcaccgatgataatgggaaccccatttctgtagaacttactcctgcaaccatcacagtcgggagccagaccgcagcaccagtcccggtccagacgccccagtcctcctctacccaggtacctacccctgaagtaactccggaaattcaggaaaacactccggtagttgaagtaacaccaaccgtgacccccacaccggttccgacggtcgttgcagatttcactgcccagcttcaggagggatctgctcccatgaccgttttctttaccgataactccactggatacccaacgaaattcatgtggaactttggtgatggttcgagtgacaacacatctcctcttcagaatccccagcatatttatcggattcccggagtgtacacggtatctctgacggcatcgaacagtgaatataccaataccacagaaaaagccggttttatcacggtaaagccgatgcaccttcctgttcggggagcaaaaaacaatgttacgattttttctgtacctgacggagcagaagtatacctgaacaatgcgtatcagggtgtaactcctgcatttctcaccaatcttacgtccagggattatcaactccggcttcataaggagggctattacgatgttgtctctccgatatcgatccttgatgatgtccttccaaccttcatctccgggtttgtgatgatgccacacctcgccgagattggagaattatctgcaaatccgccacagaccggtgcagcatacatcgtttcatatccggagctggtgaatgtcacaattgatgataccccggttggaaagacggatatcatggttatgaacctcgctgtcggaatgcataacctgaccttacaaaaggaagggtatgaaccatggaatgacacccttgagatcaagaatggccttgcagtgattcagacctatcattatgaagagccatacttctctctgaacaggacggttgaatatgttcagtatccctgaattatcttccctttatgagaagatttttagcaatttcagcaccatcttgcacgatgggacggacaggtgaatgaaatgaaaggacaaaattttggtatctgtgttctcgtcctccttctctctctgggggccggcgttcacgcagctacattatctgcgacagatctgactctggtaacttccggttcttccgggagtattgatattatgctggatcaggcttccagtggattagcgggatatcagcttgaggtatccatgaaccctgcaggttctgcagaattttcatcggttaattttcctgcagcctttagtatgaattctgcgtcaacgctccctgcttctacagtcagtattgttgcagtagaccttactgatcagattaaagctggagcaagttcggtaaaattggccaccctgaacgtacaaggtctggcagatggttcatccgaggttcagattgcaataaccgagctgacggatgataatggaaatcctgtatctgtaaccattcagcccggccatgtcactgtgggctctgcgattccgacacctacaccaaccggtgaaccgacccctgctccgacaactccggtcccgacacctacactaactagtgggccgactcctgttccaacgactccaatcccaacacaaaccggtgaacctactcccaccccgactgaggaaccaacccatatcccaacagtagagcctgaaccgcttattgcagcctttactgcacagcctatgaccgggacaccaccactaaccgtgaactttacagatcattccacgggaactccgaagaagtggagatgggactttggagatggaacactctcaacagttcagaatccaacccatgtgtacggtggtatcggccggtatacggtaacccttgaagtaatcagtgataattactcatcggttgagagaaaaccggagatcatccgggtcgttggtgactacccgacaggcccgtccggatttgtcatggtgacctcacagccatccggagctgaggtgcatatgggtgacctttatcttggaacgacccctgccaccctgattgtgccggctggttcccgttcgctcacattccagaaagaagggtatcagaagaagaccgtaaatgtgacgatacgtccgaatgagatgaagctgattccaaaagttatgctgaaaccagtctcataaaatctcttttttgccggcatatacacattgaccaaaggagatacacccgtctccaagtggcatatcatggtttgtgcacaattggtatccgtttttatgcaccgtctcccggatagtattccggatcatctcgttatatgcaacgcccccggataacgcaatggtttgtagtcctgcacttgcagcggcgttacaggcaattactccgatccctcgtgccaggttatactggatagatgctgcgatctgctgaatattttgagaatcttttggatcagacataaaccgatctctggcttgtttaagaagtgaaggtgtatcaagtacctcagccgtaccaattctggtaagcggaatctcccaggtctccggagatgctccataggcggctgactcaagtttcatcgcaggctctccgtcgtatgtctttttcctgcaaattcccaggagtgcagctgccgcatccaggatcctgccagtacttgaggtgacagcggtattgaaccgttttgagacttgtttctctaatatggaaagatcctgttctttccatccccgtgacaaaagtaactgatgggtctgttcatcaggaagaataccatacaacatccgttcaggccagatagtagccagatcccctcccggcatcagcaccggcataaggtgccctactctggaatagtgcggagcagaaccctggaatatctcaccgccccagatcgtcccgtctgttccgtaccccaccccatcgattgcgattccgatacactctttctgacatgatgcagcgatgtgagcctcatggtgctggaccggaacaagaagggccccggtctcgtcactcaattcttttgcatatctggttgagaggaactgcgggtgaagatcatgagcgatgattttgatatcaggctgcatcagattacacaggcaggaagttgtctctttcaggtatgcataggtccctggatttctgacattgccaatgtggggtgaggttatacaaaacccctgggtatagagggttacggtggcgttcagttctggtccggttccaaggatggcggtattaccaagatctatctttgttctcttcggtgcatatccccgtgaaagacggattatatgtccttttctgatgaccgagtcatcacagcggttcatgatatcacgggtatgggtgaggtaataatcggtgattctggaaagtttactcaatgcctcggctaatgtcgtaatcatcggataaccgggtgcattagcactggtcatgataagatatggtgctgaaagataggagaagagaagatggtgcagaccggtataaggtaccatgcacccgatagtgtgaagattactgacattatccaatgcgttgggatcttttttatccagaactacgattggggagatctcactctgcaggatcttttcttcatcgggagatatggatgtattatcaagaatccattcttttctggccatgatggcaaagggctgttcagttctgccaagacgctcttttaatgtcctggccatatcgccggtgcatgcgatatgaaacccgccgattccccgaatagcaataatggatccctgatcaaggagttgtgcagttctcttaatcgggctttgttctttgatcactgcaccggttccagaatgaagaactagttctggcccgcagatctgacaggcgatcgtctgggcatgatgtctgcggctgaagggatctgaatactcctctgaacaatctccacagggtggaaactcatccattgccgttctttcccggtcatatggcagggttttgatgattgaataccggggtccgcagttcacgcaggatgtcgcaaaatatccttcatacctcccgtttggggtgaagatatctttgatacagtccgggcaggtggcaatgtccggaggaataagacctgtcctgacaccatcatgacttttcagtatatgaaaggatttcggtgaatcccctgagagcgggtgcacttcaactgagtcgatggtggagagtggcggaccttttctcagatcactcagaaaatcgtcaaaattatctccccaggcatctatctgaacttctgatccggtgttacagactgagccgcggattccatgcgcaatagcccgggcgtacacgaacggacggaaaccaaccccctggacaatcccccttataatgatatgaccctgttttggcatttttgtacaagtaacctttaattttttatccaacgttattataatagggttttgaattgacgggtcatgtgcggattgtgaatgatccggtagagctggttccccttttcgtggtatttaataatactcattataagaaaattctcgaactcctgaataagaactggatgacccgtacggagctgggtgatgtagtcggaacagattacgtcagagatgggctgctcctgcttcggaaaggaaatcttatagaggagaaatggagaatgcctgaaccaggtaagaagccggagaaggaatacagagcgaattattgtaaggtccgtgctaactttcagtgtaatttttcagatctcggggatcttcttgcaattgcattcacgaatggggatgatctcaaaatgaaaggtgatagtgtggaagctgaactgttacggggaaattgctccataaatgacattgcgagaaaattcggagtctcacctgtgattataaaagggatcgcgaagagaattccacatctggatgtaaaaggtcagggtctggtcgttttggatgaatgagaatgatccaggatacaccatcctaaaaaataagcgtgatgttaccagatttcaaatcctggttgatatcgcagcacatcagcctgcaatacggcagcaggagatagcggcaggtctcggggttactccccaggcgatctcggaatatgtcagggaactgactgaagaaggtatgcttaaggcaccaggccggggcaggtatgaagtcacaagggaaggtgttgagtggatcctgcaccatgcagaagttcttgaaacatatgcacggcatatccgaaatgatgtcattaaacaggtttcggtctggacagccattgcagcggaggatttaaaaagaggtgatcccgtcggagtgtatatgaaaaatggtctcctctatgcctcaaagcagcctcagtcagcgaatggcctgtcagtttccgatacaccaaaaggtgaagatgcaggggtttccggtcttgagggaatcataacccaccgggaggcgactgttcttgtctgcaaggttcccagggtggaacggggcggctcgcgaaaggtcaggttggatcttctaagggatgttatcagcagggttaccgtggttgcctgtgttggtcttgaagcatgggtctctctaaaaaaaattgatcgcgttccagatctctatttcggatcacgtgaaggatcggttgaagcagccctgcatggtatcccgtgtgccattgtgattgtagatgaatttttcacagattttctcaaacagctcgagcaggcggatcttagttacgagatccatgacctggtgtcttcatgaaggcgataatccagccgacgaagaaatattaccgggttttatacatcgatacgcatcatatccggataacggggatgcttgagcttgttgatactcctaaaggcatcagaccggtaaaataccggatccggcatacgaaaagcgggggataccggaacactcccagtaaggatctggtcactcatctccgccgttcccgtctttacctcacggcgaaggataaaccctttgaatcatttttgcaggatcttcaaatcccgtattcgtatgtgtcactctgcaggttctgtctgatggatgaccgggtcacagaacttgacaaaaagaacgctgtagggtttggagaggaagagcagatctgcatggattgtgcccgcaaggaactgcgcagggagctggtgcatatgggccggcttggaagatccgctctttcccatcttgatgaacttctggaaaagtacaggagtgttgaccgggtacttgcaacgatagagccagataggctgacagtcggacatacgctctatgatcgtcttgaagctcacccagttgtgcagacagccaggattgaagagcttccatttccccgtgagtttgtaacggcatgtggcgttgagtcattaatgccggttcagcagctggcagtagaggcagggttgttgtatggcaaggatctcctggtggtttcggctacagccagtgggaagacctttatcggtgagatggcagggctgaaaaattaccttgaaaagaggggcagggttctgtttcttgttcctcttgttgccctggcttatcagaaatatgagcggttttcacagaaatatggtcatctcactgatgtgtcaattatcaccggggccagcaggattctggtgaaagataaccgaaggccagctaaccggaacaggaatgctgggattcttgttgctacctatgaagggatagatcatctcatgagactgggagagtccctgacaaacattggcacggtgatcattgatgaggtccagatgcttgaagatcgcgaccgtggtcatcgtgttgatggtctgatcgcacggatgaagtttgcatctccgaaagcacagtttttatacctcagtgcaaccatcgggcatccaaaattactggctgcaaagctcggttcaaagttggtcaggtatgatgatcgtccggtctcactggagcggtatctgatattttctgaacgagaacagaagattccaacagaacgtacccttgtggcagaggagtataatcatgtatcagacaagggatatcatgggcagaccatcatcttcacaaattcccgtgcccggtgtcatattatcgcagagaagataggagagggcgttgctccctatcatgccgggctgacacaggcagaacgtcgtcaggttgaggaaaagtttgagaaagggcagcttcgtgccgtcgttaccacggcagcccttgcagcaggcgttgactttcctgcatcccaggtaatttttgactctcttgccatgggtattgaatggcttactgtgcaggagttttaccagatgtcaggaagagctgggcgtcctgattttcatgatcttggtaaggtggtaatccttgcagaacctggtgggagttatataagaggttcacggctcactgaagaagaggtagccatgggtcttttaaagggggagatgggagaggtggccccccagtacaatcttgagcagagctctgaactgtatgttgcaaatgcggtgatatgcaaaggagatgtgagttcaattgagaagatcgaagggtaccttgttggtgaatctgaaccggttgaagagcttcttataaacaggaatctcatctccaaagagaacggactcattcgtctgactcccctggccagggtaatgtctgaacattttatcggtgttgagcggttatcccgcatcatacgtctggtcaatgagatgaaagatccgctcgacatcctggcagatcttgaatgcgcatcagatgaagaggctgcaaaggaaaagatccgaaaagagaatgagaagggtgatagccaccggaaaaagaaaaaaagacatggaagaaggatgaaaaagaattcttaagcttattttttgcctattcattattcaacaaatattttacctttttatctgattctgcggtatgttactgggttttaattttagtatagctacaattaattttatatatggtggaagataacttcttactacccatgtggactagacccactggggatgactgaaattagcagttcaatagttgatcttgaaaaaggagaggataatcatgggctgctacgagatcagcaatactggtgatcaatcaggtgattaaaaatgacgctagatagtggtgcaactgcgtggatacttgcctctacctgcctggtcatgctcatgactccaggggtcgggttgttctacggaggattagtgcggaggaaaaatgtcatcgcaatggtggcactagcattcctcagttatgctctcgtgagtgtacagtgggtcttttgcggatattcaatcgcattcggctcagatattggtggatttatcggtggtcctgactatatcggcctttccggagtcgggatggaagcttcagctcttcccataccggatatcctgtttgcagcattccagctggtatttgctgcactgacactggcaatcctgacatcaggagttgcagaacggatacggctttcggcctttgtggtgttcgggctgctctggacaacgctggtctatgatccccttgcacactgggcctggggtggtggctgggctgcgtcgcttggagctctggactttgcaggaggaactgtcgttcacatcagttcaggattcggtgccctggccattgcactagtgattggaaaacggatgggctttggagaaaattcgatagaaccccataatattccgatgactctgcttggtgcggcgttgttatggtttggatggttcggatttaatgccggaagtgccatagcagctgacggtcttgcttcaaacgccctcatggtcaccaacaccgcagcggctgccggagcactgacatggctgcttgcaagcagtatccgtgggaaaccaagttcagtcggcatggtgtcaggagccattgccggtctcgtcggtatcacaccggcagccggatttgtcgatgttccgtcatcccttgtcatcggtggtgtagccggtctcatatgttatggggcactgctctggcgcctgaagaaaggatttgatgagagtcttgatgcatgggccattcatggtgttggtggtctgtggggtgcaatcgctaccggtatatttgcaagtgttggtaagaccggacttcttgccggtaatgcgtatcagtttgggatcaataccattgatgccctgatcgctgtcggatatgccttcgtggtgacctatatcctggcgatgatcatagacaggacaatcggacttcgggtatcggaagatgaagaatatgtcggacttgacatctcccagcatggagagcgggcacgatcataacagaggtgaatcatgaaactcataaaagccatcataaaaccagagcggcttgacgccgttaagaaagcattggaagacgccgggtatttcggaatgaccatcaccgaagtacagggccggggagaacagaaaggtatcagccttcagtaccgtggtggaacaatagaggtagatctcatccccaagatagagatggagattttagtctctgcagataaggtcgatcatgtcattgaaaccatcaagaaaggagcatatactggaaagattggtgacggaaggatctttgtcatccctgttgatgcatctatcaagatcagaaccggggaagtaatcactgaataaatcttgtcggaattcatgggttcctgccagagaaaaaattcctcccccttttttagaaagggaagaaatgttcctgttccctactctgaataacaaatccaccggtcatatatcggatctgcatccgattcaaatatctccgctttttttccggtgtcaaaaacccagtcttttatctgattaatctcgtgttctgtgccagcggtgaaaagaaccctgtctgatgccatacatgcagcaccaatgatctcctgccatatatgtgcattaaatgaatgaatttcaccgatcataaatccacatatcaaggaagcctgtttctgaatgaaccggtttatcatccgcccatctatccacatggtccgttctggtttgagccgtccggctttcattccccggacaaggagggattcgtcattatcataggctatcggatgcattccacaactttccatgaccattgagcctacaccggtcccacagcagcagtccagacagagcccgtgctgatcaattcctacggtgtttcgtaaaagagtcttaatgctttgaaccctggctggattgagatcatcaggtccggggaggacagaatcacacagcagggtactgtaatattcccttaatgcatcgaggatagtctcattctcctcctgatacatctcccattcaaactgctcgaaaagatcgatgagtgccagtgatggctcacggaacatggttacacacccgttccacgctcctccgctgtcagttttagcaaaaagaaccgggttctcatcttcattaaccagtatctttccgtcctttcctggggaaccggtcataaaatcatccatctcctgatatatcagatcagaaaatgttggttcaacaagagagatggtttcaagttccagcatttgtgcaattttcatatttcaagtcagaacctgttaggactatgaaaaaaaagaactatcggtttgaaatgcgcaggtcaggcaaaaagaatacaattgaaaattctgctcttatagaaattctttgtcattcatgtagggcctgagtacctttggaatcactacagagccgtcttcctgctgattattttcaagaattgcccgcatggcccgtgaagttgcaatagcagtagaattcagggtatgaacaaactgttttgactcaaaatcctctttgtccctgactctgatatttaacctgaccgcctgatatgtggtgcagtttgaacatgaaaccacttcacggtattcgttttcacggggcatccaggcttcaatatcatatttctttgctgcaaccgttccgatatcaccagtgcagatatttacaacccggtacgggatctcaagtttctggaatatctcctcagcattttcacgaagttcttcatgaatcgtccatgaatcatccggatgacagtagacaaactgctctactttatgaaactgatgaacacggaagaggccctttgtatccagaccatgagatccgatctcccgtctgaaacatggtgagagtcctgcaagtctgagtggtagatccttctcttcaaaaatttcatcctggtacattgctgccatcggatgctcactggtggcgatcaggtatgcatcatcatcctcaattttatacatgaccttctcaaaatcatcaagatcagtaacttcctcgtatgatttccggttaatcatgtatggaggtatgatgggcgtataccctttttccatcaaaatatcaagggaaaatctctgaagggcgagatcaagaagcaccagatttcctttcagaaaataaaagcccgctccggatgttttggtagcacgttcaaaatcagcccagtcattatctgcagcaagttgcccgtggtttttaagttcaaaggtaaaggtccggggtgtgccatatctcttcacctcgacattctgggtatcatcagcaccaaccggtacgctctcatggagaatattcgggatacgcatgaggtaataccgtatctttttcgagatctcctccatctcagcttcattttcttttatgcgtccagggagccctgcagcttcagcgatgagtgcagatgcatcttctccggctttttttgcacggtttatgtcatatgagatggaatttcgtcttcgccgtaattcattggtctgaccaataagttcacggtgacggatatcctgaacaagcaggtcatctatccatgctaacttctccatatcatttcgtttctttagatcttccctgatggcatccggatttgcccggacaaatcgtatatcaagcattacagtacacctggattctggtaataagaccctgatctattttgattgccagtacctttggtcttccccctacatcacgatgatcaccggatctgctgatgtatgggaacaggttacgttcagcgattgagagatcgaaaataaaaaaagtttcaggcagaactcttcgggagctcaaccttggttttgattacttcaacacgacgaaccgggtgaagctcttttactttcttaaagagttcctttgcaagatcgccgttgatgatattgttcacaaaaacaccgagttcattctctttgccaaaggtcagaacatcatcggtaagaatttttcttatctcgtgctgctgactctggtctgcacgggtgagcgtgaaacaggtaactgttgcacggaccttgcagccatccttgctgacaaagtttaccacacagtcaatccttgaggtacggcgttttaccagtgatctgatgaaatcacgcgcaagttcatgaccaatgaatgaggtgtatgctgcatcacctgctacattcgtgatagcaaacttcatctttacattctgcttggtatagtcatttaccaattctgagagcggtgcctgcatgacccgtcccataagtttggacggatcatctgccacggtgtcaccaaggtatacttttcccacattgtcagggctgtacaccttataccaggattttgctttccatccgtcgactcttctgcctgttggttttttcgctgccattattcacaccttttttcattatgatgcatatgttctgacttcctgtattgatgtcaaataattcaaccggttagtttctcccggtattattgtgaaactcctgatttgatgtttgtgaggatttttcacaaacttcttctgctacggtgagattcataagataatcgtccattgaggcgatgactgaccggattttggtacttgtgatctgtgtgataacataactcccctcagcattcgttttcatctctgacaagttatcgacagatatcgaatccgcaatacattgtgcatggtcatgaattgtccggatgataccctgaatattcatgagctgaaggcctcaacaacctttgatgaaaatgtgtcaagatattcacaagcaacggtcgctcctgccctgttctgatggcctcctccatatcctccgtattcaagagccagctgacggactatctctcctgcatattttccactcctgccgtctgttcgtatggaacaagagcacgtcccgtcatttttttgcactgcaataattacgggggaactgtccggtatattccgaaacacggtatcggcaaggtcactggtgagatgttgatcgctgcacatgatcgggccttttttatcatcctgtgaacttgcaaggaatcggttcatctcctgaatgagggccagacgatgtgttcgtgctatctcataggccttttcagtcagtttcgatgaacgaagacagagtgaaactgcaatgcttccatgacctgcttttccacatgaatccactataaaggccatattatgcgcatgctcaatcacttcccgttccagcatccacatatctccccatattgaatccaaggtttcaggtctgcacctctctgcggcctgcagaacaaggagtgagcagagtatatctccctgaagggtatcatcaatcgttgatgttcgaataatattgagggattcctcctttgagccggaaatcccatagagaaatggttctgttgagagctcaatctgctcggcaggcgttctgcctggaagaataattcccctctttttactgatgatcccgttccccagggcatcaagatagatatcctggtttttgccggtcagggtctgcccgtctccgatgacgccaaggagtgtcaatcctgccagatcacggttatctccaagagcatttgcgaccagatatgcagttcccgctgcgcagaggtcggtgtctccatcgatcccgtcatatcttgggttcacatgatgcgggccctcaaagaaagggaggtgatgatcaatgaccatcgtctcttcaggtaatccggcaagacctgcaccaagatcacaaagaagtaatggcctggtctttgggatattatcttcagacaaccggtgagttatccgaagtctgaatggaatgcctgcccggtacagagccatcgccatgatcgatcctgctgctatgccgtctgcatcatgatgacagagtatttcaacagaactctgtctggataattcatatgcaaggtcttttgcagcagtttctatggacatttcaaccgtaggattatttggacaggagaatttctgcagtttcaggtttgtaaacccagtcttttggaagctttttactgcttacatagtatttgaccagtctgcggacttttgattcagtcagcatgagctggcgtttattatgaatgtcccgcttgttttctgcgagatgcttgcgcattccaagggctttctctatcagattgcggaggtcttcagggatttctgatgcaagatcattgtcacgcaggatctgggtgatcttttttccggttgcgagcttgacgctgggaacaccatatttgtctctcattacaagcccgatctcggctgttgagcttccttgtctgcgcaggtctactatctgcttgatgatggcttccttgtccgtgttcgaccactccggagcctgtgtccggtacggtctgactgaacgtgaaatacctcttctacgggcatgcattcgtgccatttctaaatcctcctgtaaacagagcaaaatcctgagagagaaaagagtcagatacgactaatctgctaactctctgcaatcccaaagcccagaacgggcagtgatgaaaatcacgtcggacttgcgtctgccagcactataaaaagtgcggtataatatgattcgtgtcaggtgataaggatacccgtcaggagccccactggtttatgagattgataagtgtgcggcacccctccagttcaagagccagaacctcatccctggtcattcccattgatgtctcaccatcagcagtgagcatatccggtccacgaatgacaattcttgatcttccatctgcagagagcactttttctgcttcagatatatgaatgaaagatctccccggtaaaataatcgtatccggcatggtggagagatccagttcctgaatatcatctatggtaatgagatccgcgatctcttttttcaccatgaagatgagattctcacctcctctcgctctgaggatctgatccaaaaaaggacctgctattgcaccggtaatgactccggcacactttgaaatcattggaagggtttgaagatgatctggttcatgggccagaatgaatggagaaccaagatctgggtcatacaggggcgttccagagattcttatactggtaatcttttgtgtttccttcaccagatcggcaaattcgagaggggtatggattcgttgtcctggaatgataggtgcattctgtaggataaggccctgctccggagtgtttgcaaagcgcatcagaatagcacctttcactccggctttctccagccatctgatggtatcaatcagaaccttgccgtcattcactccaggcagaattaccagcgcggcatatacctcaattttttgtgcaagcctgtggagcgtttccagcgaagcttctggtgttggatctttcatatatttccggcgaagttcagggtcatgggcaaatactgtaaaagaaatctcccgaaggccgttctctatcaaaaattctgcaatatccggattatcaaatccctttccgctggtatatccaatgtggataggtgcttcaagagaggataaaagttccatcaggtctgtaaattccgggtaacaactggggtctccaccaccagaaatcgtaatccttgtcaggtcaccggtgagcatctgaaggtcggcaagtacttttcccgcaacctcctgcaatgggataaagcccgaatacttctcctggacactccgcgaacaataatcacagcctttcgtgaaaggaagacagtatttgcatccaaatgcagggagatcctgtgcgtgtttgaaatagcagtatgcacaaaatcctcggcagtctatccctggtctgcctcctatgtccacggtcagctgtaccattcctgattggtctgtaccagagcaggaaaaagaaaccgatcaaacatcacctttaagtgttgagaggtataagttgttcccgcgcctcagtggcttagctggcagagcggttgacttgtaatcaacaggtcccgagttcaaatctcggctgaggcttcccttttattgacaacccatcctgaattttcttcaaaattaggactcttgttctaaagagactcccatcagtctgattgaaccaattcactgcgttcgtagcatggattggtcagtgatacctactctcgatctatagaataatcatgccggatggggcagcggtatgcgaatgacttgatagaccggatcaacgcgctcagatactgaccgctctggcgctggttgattctgaaaaaagaattatgagttttaggtcttttcacaatatattaaatactttctctgaccacttaaaataggaaatatatttgagtattttcagcaaagtggctctctttatcggattttactccctgaccctctctgtgattcagcttttagccacaaaacggatcacaagaatataaaatataccagacaactaagtaatgatacttcggagttactctcggagtattccatatcttcatacatcaggatagatagccggttgtgtgaggtatgggttgtattcattcggaggacatgtaatgaacgcacgatttgcagttgtcatgatggtgcttgtcgcacttgcaatcatggcattccccgctactgcagcaatcaacaagatccccgccggaggagaagttttccttggtgagaagggacttgatgtctctgcagcaaccggtggctcaagccagattgcatggtggcagccaggtaccaacactgagactgagcagcctgcagatattcagcaggttaccaacgcacagtcattttatgtttctcctgatatcttcgtcggaaagaccggcaactggtatcagtggaacggcagcgtaaaaggcccgctcgcatttaacatcaaggaaccatcccttaaccttaaggtctgggacggatctgtaaatgaagatgtgaccggcaaggcaattccagtaggcaactacgggaactttgtcgttgagaccaacatgcagagcatcatcacccgtccagggtaccagcctgcagatgcacctttcaagatcaaagtaaagagtgcagatggtggtgtctacaccaaccttgttggaaacaacggtaaggaaatctcgctgacgaatcttgctgtcaaccagcagctctggtactgggtatccccagacgagaagcacactgagccggcatccaacgatggatggaacactgcagccgaggacaagtatggcaaccgcatgtacaaggcaggtacctatacagtctgggcagagtgtaacgccaacaaaatgaaggatcagtacaagtcaccagacggttcagactacaccggaaagaccatctctgcagtaaagagtgttcagatcgccaccgaccaggtgaagatcgaagccaacaaggacactgtagtccgtggcaacccattctctgtcaccatcactggtgtcccgaacgctgagtactatgtctgggcaaagggatccggctcaatgaccggccagcctgatgaccagccaccgatgattctgtccacccaggctgatgtcaagcaggacgcagctgcaggaccatacgagatcggtaagtaccagtacgagggaggagcagggaagagcatcaagcaggatgtccccgatgatcccgaattccatggaaccaagttctacgcacttgtaaaacttaactccagtggaaccagaaccgttgagtggaagacctccaaggacaccaaggacaagaagtacactatccgtgtagaacgcaaatccggaagccagtacaagtctgatgaggtcgatgtcaaggtagagaagggcgatgttaccatcgttgcatctggagaccagagctactaccttggtgaggaagtcaaactctccggtaccaactccgagactgacgttacctatctgttcatcaccggtccaaacctcccgaacgcaggtggtatgctgaaatccccacgtaaggaagtcaacaacgaccagccggcatcctttgaccaggctgacgttcaggatgacgacacctacgagttcaagtggcagaccgccaaccttgagatggatgcaggtacctacaccgtttacgcagtcagcgctccgcgcgacaaggatcacctcagtgacgcacagtacgacactgtctcacttgtgatcaagaagccgtacatccaggcaaccgcttcagcaagtgttgttgcaaagggtgacaagatgtacctccgtggtactgcagaaggcgacccgtccaagggtgtcgcaatctggatccttggtaagaacaaagttctctacgcaactgaatccgtgaacgatgacatgtcattcgagcatgagattaagagcgcagaaactgcatctctctatgcagggcagtacttcgttgttatccagcacccaatgtacaacaatgagttcgatgtctacccagacaacccactcgaaccacagaagatcctcggtgcatacccgacccgtgactctgaagtcttcagaatcggcggtgcaggtgcacttcagggaactgacgcagcagaggcacttgtaagagcaattgactcagctatggtagatgatatctacaccaagatgcagttcctcgttgaggagccaaaggtctccatcaatccgattggagaacaggctgtaggttccaagtttgagatcactggtaccaccaacctcatgtatgacgacaacgatctgctggtcgaggtcacttcatcctcattcaagccgaccgacaagtcacagagtggtgagttcaacggtgcaaccggaactatcaaggttcagcagggcaccgatggtctgaacaagtggagtttcactgtcgatgcaagcaccttcaagccggatgagtacatcgtccgtgtctctggtgttaccaccgatgttgtcgagactgctctcttcaacgttgttgaggctggcgcagcaccggtcgccccggttgttgcaccaactgaagcacccgttgttgaagtaactgcagaggcgccagctgttgaagaaccagttgcagaggaaaccaacgcaactgaaaccaacacaactgaagaagcacctgttgcagaagaaccagtcaacaagactgcgtaaattaaatcaggtttaacatctgatttccctggaaacccggggtttctttttttttataaaattcttccggaatatttcagattattttccgaattgaccatttctctaccaaaatcatcaaaagggatcctaacgatacgtaagaaccaatgaattatcgttttgcagatcggatgagaaaaactccccgttcgtttattcgcgaaacactaaaagttacagaacatcctgatatcatctcatttgcaggcggtcttccgaatccatcagttttccccgtccaggaacttgcgaagacagctgaggaggtaatcagggaagatggcccggcggctcttcagtatgcaacaactgagggatttctgccattacgaaactggattgcagaaaggtatgctcacaggtatgggatttcggttacgccagatgagatccttattacccacggttcccagcaatgtcttgatttaattggtaagatattcattgataaaggcactcatatcgggattgaacggcccgggtatctcggagcaattcaggcattttctctgtatgaacctgcatttgtaccgatctcattagaaatggatggccccgctcttgatgatcttcagaattttctgcagataaagaattgcgggtttttttatggggttccaaattcccagaatccctcaggaatcacctggtcggatgaaaaacgcagggcagtggcagattctctccatgataataaagggattttcatcgaggatgatgcatatggggagatcagattccggggcgatatcccgcgtccggtgaagacaatggttcctgatcaggtcgtcatgaatggctctttttcgaagattattacccccggaatgaggatggggtggatctgtgctccaaagcctataatggatcaacttgttacggcaaagcagggcactgatctccattcaagcatccttgcccagcggattatataccgatatctttcagaatatcccattgatgcctacatcaaaaggatttcagatacctataaatgccaatgcgactctatggtccgctctattcaagaacattttcctgaatcagtttcatataccattcctgaaggggggatgtttctctgggtgacccttccggagaatatatcctcaatggaagtatttgcgagagcattaaaggagaaagttgcggtgttacctggtattcctttctatacagatggaggcgggtttaatacgttacgtctcaactttacaaactcatcacatgaaaaaattgaggacgggattattcgattaagcagggtactgaataggttacttgaaaaatccgaaagataaattcaatttattcggatttttatgcaacgataacccaatttttgtataagtaattcttaattatttatgtaagattcttcatgaactagttattgactacggaattcttttttgaacttatcactgctgtaagtccgctttgtggaggtattgtcttttccggacctattgtataagttgatataaccattggttccggtttctcaacgattattgaaaaaattttatcaaaaattatgttattttcaacatcgctaaaaaccactgataactctttattctttgttgcctggaaggtatatgatagattctgagctcctcccttagatacatgtttgtctgaaagagttctccctttctcctgtattgacatctctcctggaatatttgtgttattacacacgatctcaaatttaattatctctccagattgaaccagtatattattgtctttattcttatttgaatcaaaaatgagagttcttccagataatatctgaatatttatatttacagaaggctcctcctgaccagatttatcagatttagcaatgtgagaattgtctgttataatcatttgaattggttttggagtagaaaccggcgatggttcagggatggagtttgggttttggttataagaatatgggatgtaacccttgcaagggcatgaacatttttttctccccttgactattacttcttcacagccatcatacatgcagtaaggatcatagtcactcgggttacagatacaggattcataatctggattaaattcacatgaacgacctggtgggcagcacgcagtagtacctgaatatgaagaatatttctgagtctcaattttttcgttataattatccgatatattctttgaaaaagtggaggcttttaatgaatcaggggtatcagctggagatgtgctgataataatacagaggataagcacgttcacaataatgagaaaacattttatattcataaagattgatggttccgagatctcttattcatgatggttccctaataagacaggtattatatagtaaaccgccatccacaatgataggttcggatcatggtatcaggtggacatgcgatacattcaacatttatcttcgggtcaatggtacgagcaaatatcttgtaatcaatcagaccaattctcttgcaaggaaataacgggaggccttttctgtcacgtgccgcctgggttctgcatgagttcataaataactccagaactcctgggacaggttttcgtatttcataggtgttcaggagggagaagagccgatggtgcagggcagtttccaatacctccagtccgccaccggaaggaagggctagacgggtcatgattcgatccgcttctatcctcgagaactctttccagacagcagcatcacactcaagagcgatatcaagcccaaaccgtttttcaatctctaaaaaccatagtccgtcgattgcaagccagttctttgccgcatcaatcagttcttttttcaattctatagaattatcagtcatacaatgagtctccgttcaaagagccggatagccagcactgaaaagactatggttccgaggactatccatgtgatgttcaaagcccataatgggtcagtgctttcggtaagaagtcccctaatcagactgaccacatgggtaagtggcaggaatatgagggccagaatctgaacaatccaggggaggaggtgcagaggaaaaaacgtccctgaaaagagaaacatcggtgcgatgaagagagtagccgggtatgaaatggtatctattgagggtgaaaccgcagaaaaacatgcggcaataccggagaataacaaacctgcaacgaatgagagggggagtgcaaggagtaacccgactggagaggctagtcccagcagaaggagaatgatgctgattgacagagcagagatcaaacccctggttgctccccagaatatctctcccaggataacttcatgaatggtgatcggtgttgcaagcagtgcatcaaatgtcttctgataatacatgcgaacatatgtcccatacgcacattcaaagaaggatgcattcatcacggatgctgcaaggattgccggtgcaataaatctgacatatgggagcccctcaatatcggtgatatatgctccgattccaaacccgatcgccccaaggtacaaaagaggttcgatgaacggaggaagaaggttgacacgaatatttttacgaaataccagagcattccgaagccagacatggtatgcaccaataaaaaggatcctgaattttttacccgtcttcctcctcattcacgaatcctccttccggtcagcattaagaatacatcttcgagtgatcctggccgggtgataacccgtattccctggaatttgtccatcaatatgttagccagttcacgaggtttatcggttcgtatctgtatcgtctctccgccaatctcaaacgagatattcatcaaattcagatacctgctaacctcatcagtattgtctgtctcgacaatatccataccgatataggctctgaccagttcatccggagatccttcaaccagaatattcccatgatccatgatcaccagccggtcacagagacgggctgcctcatcaagatagtgtgtcgtcagaacgatggtgtgcccttccgcacgtaatttcagaagtttctcccagatgtgatggcgggcctgtggatccaggccgatggtcggctcgtcaaggatgagaagatccggattgttcatgagagatcgtgcaaggtgcagtcttcttttcatccctccagagagtttctcgattatagtgtccattttagcctcaagttcaaaaaattcaagaaggcttagagcacgtttttcagcatcggactttgggatatcaaagaatcttgcatacatcacgaggttgtcaaaaactgacaggtcgggatcgagatttgtctcctgtgggacaacaccaattctcttcctgatgtttcttcctgaaaactccggatcctctccgaatattttcagttctcctccggaccggggagagacacattgcaccatcttcatggttgtcgtctttccagctccgttcggtccgagaaatccgaaaagttctccttttgttacagaaaaagtgatgccatttaccgcagtcagctcgcggtatcgtttaataaggcctgttgcctcaattacctggttcggaagagaggagtctgatgtattcatattattgtgtcaatagaaaccagccgataagaaatcccagtatcgctccgccgttcagtggtggtagtcctgcatgaggccggcctgaatgtactgcataaagaaggattccaagtcctgcaagagatcccagtatcacccctattgccggaaggttcagtattcccattccacctcccggaataaatacggcagccgatgtcacgaggattgatggcatgatgagatccccaagacccatcagatatgcagcacggtcatgtttcggactattgttattggatatacccggatcaatactgcccccgattccgtcacgaatgaatgagtatccctccttctttggtaccacaaccatgatgggcattctgccttcaataacaccgtttgcgagggtgagcatatgttttgttttgtatactgatattgcatcatataccgagaggaggataaggagcagaatgaccggtaccggttcgagtgatataccaaacatcgatgcaattcctgctgcaagaaggacacccagaatgtctacaacataccattcggggtatttccataacaggaacgttgccgctccggcacaggctgttcctataaccagtccagactccgctgacatgatgagtccaagaagtcctgagaatacatagatatatgcgataaacagggatgcccggattatccagcccagcactcgtttgaatctgtattgtatgaggataagaagaaatgccgtgaataccaggagcatcacgataaaccataccggatttgaaagtgactgtgggtcttcaaagaccgcatatccggaggcgttcatgggcattgcaaggagaacggatccgatttccacagcaaggagcattaccggcattgcaaggatggcaaaaaactcccggatttgttccttcgatctcatgataaccagtacttacatcatgggagaactacctatctgaatatatggatgatcggatccttctggctggtattatcccgctccttctggtttcatgcgggtgtatcctgatcggatttgcatacaggttcccttttgaagcgattatcggacttctcctgatgacacttcccattatctttcttatgtggtatactcttgtcagagttgaaaaccttgcagcaggagtaaaatatcagggcagaattatccatcgggcagtcgatgatcaggcatcggatatgaaacgaagatatgaggagtctatgcgaaagatgatggatgtccatacagaactgaccagaagggtgtaccggtaggctaaccatgggtgtagcactcagagatattcttactgacctgaaacggccggctgaaaccgatgaactgaaaggagtcgcggcaatcgatgcatttaatgcgctgtatcagttcctctctatcatcagacagccggatggtaccccccttatggatgattcgggaagaatcacctcacatctttccggcatcttcttcagaactgccaactttctgactcagggcatccgtccggtcttcatctttgatggaaaatcaccggagatgaaaggcaggaccatccaggaacgaagggatgtccgcgaagagtcgaaagaaaaatgggaccaggcaaaaaaagagggtgatctcgccggggccttcaggtatgccatgtccagtacggccatcgatgcctatattctgtcttcggcacgtcagctgatccagctgatgggtctgcctgttgttgatgcaccatcagaaggagaagctcagggggcatatatggtcctgaagggggatgctgactatgttgtctctcaggactatgacaccctcctctttggtactccggtcctggtcagaaatcttaccatttcaggcaagcgtcggcttcatgggagacagataaccgtccagcctgagcgaattgtcctgtctgatgttctcagtacccttgatataaccagagagcagcttatcgagattgccatcctgaccggcaccgactttaatcccggaataagggggattggtgctaaaaccggattaaagaagatcaaatccggagaatttgattcaattatccgtgagaaacttcctgattttgatcctgaacctgttcgtagttttttcctgaatccccctgtcaccgattcatatactcttgatcccggacggattgatcgtgacggaatcagggcatttctctgtggtgaacatgggttttcccaggaccgggtggatccggttcttgataagatatcaaagaaggagaagcagaaaactcttgagagctggttctgacctcttttcgtcacttatttttatacttgaagtgcctacaggtacctgatttttacttatggcagagtattctggtcagatgcagaaatgcgtgggtttccggctattatgtgttttcgtattctgtgtgtgtatctctggggttctaatatccataacgcatgctgatgagccggaggagaatatcacgaataataccagcaatctgtcagctgagtgggtcgtggattttaccgcctctccatttgaagggtatcctcctctttgcgttcagtttactgtttcaggcccgaatggtgaatatgtatgggattttggtgatggaacaacgtcatatgttatgaacccggtccattgctataaacagaagggatcctactgggttaaactgaaatattcctatggcacaatcgccggggaagtttcaaaacctgactgtgtgaaagtcggagatcctgatatgtatgttgattatttcgcagaaccctcctctggaccagccccgcttactactcagttttcaataatcggcaatcctacaaatatcatctggcatttcggagatggaagtgatgatagtactgaccttagcccacggcaccagttcagggaacctggaaattacagccccaccctgacatattgtattgcaggttcctgcaacaagatctcaaaattcaattatatcgaggttgcaccgggcaacaaagtagattttcttgccgaacgacagaatggcactgccccgatctgcaccaggttcatcgtctatggggaggccgactcatttcaatgggattttggtgatgggagtgtatcatatgaaaagagtccggtccattgttaccctgaaccgggtctttacaccgtctccatgacctatacgattgatggtgctccgtataccatcactaaaaaccggtacctgaaatatgttccagcaggaactcctgattttaccgctaccccggttgaagggattgctcctttatgtgttgcatacagtgtcatcaatcccactcagtcatgggagtttaattttggtgacaacagcacggcgaccagtgcacaggcaacccattgttatgggaccagtgggaattatttcccatctctgacctactgttccaataatttatgtgacacggtggaaggaaaagagcccatactcgttcatcagccccggattctgattgcccaggggagtgctctgaatgaatacaaattcagtaccgatgccccagaaggactgaaatattcctgggattttggagacgggacacgggcagaggggcctgctccctcacaccggtttgatatggaaggaacataccgggtatcactggtggtcacaggtacctgtggatgtaatgccatagcggtaaaggaactaaagatgaaacccaaagggaaacttgattttactgcgaccccattggccggctgtgcaccccactgtgtacagtttaatgaaaaatcccccgagatacccctctcccgtgtgtgggactttggtgatggtgagaccagctccgagaaaaatcccttccactgtttccggttccctggtccttacacggtgagtctgactgacacatttccgaacggcacacagcaggaggtaaaggagaactatatcacggctcatgcggttccgaaaccctcatttaccatgttccctccccacggcgatgcacctctcacggtcaagttcactgatacgactgttgattacgctgagaaacggtactggagctttggtgatggcacgtcagattcaggaaaaattgtagagcaccggtttgatgaaccagggaattataatgtgaccctgaccatatggggggccggcgactgttttggatcaaaatcacagaccgtccacgtcttaaagaaggtagattccccatatgacttttccggtcttccaaggcgtggccttgctcctctctgtacctcctataaagtgaccggtcagattcagcagtcagagcttgactttggtgacggacagaagacaaatgaacgaaatccgttccattgctatgagaccgccgggatatactcacccgctcttcaggcatgtgattcagtttccgggtgtgaggatatcagaaaaccagcatatattgttgcagtctctccctattacctgaatattactctccttcatggctggaatctggtctctgttccagtaacccttgaaccaggtttcgacaccatggatattctctccggtgttgataccgcaggacattccatttttacatggaacagtacatcagctgcctggatgagatcagcacgatctgatccaatctcccccttgtcagccttctttatatactcatcagatatggtgcaggttccgatcaggatatcaggtgaaggtccggagtataatctgaccagggatctggatgaagggtggaatcttgtcagctttgcagatatcatgatggtatctgctgatgaggctttccgatcaatcgaagaattctggagttatgttatcgggtatgatgcagaaaagcagagattctctgcccctattacgaatggagttgagagtagggacgtttctcttgacccgagacagggatactggatatttatgaattcttcggcccagatggttgggaaacagctataactgtttccacacatgccaaaaccgctgggctgcggtaatatgaccaaagatgccaaaaatcaataacacccatgcaaagagggacagtcctatgatgagtgcggatgagattatagaagcaactcctgctcctataagaagaatgagccggtcagcccgtcccaaaaatcccccataaaaccttccaatcccgaccgcctgtgcctgggttccaaggtatgatgccatcagaacgccggtcagtccgaaaacacctatctgccagggacagagcggaccggcgaaaatcccgcatatcataaaaatatctgcgtaccggtcaacggtgtggtccaggaaatctcctttcaaactctggatatccatggcccgtgcaattgagccgtcgagggcatcaaatattgcattgagaagaatgcaggcggtaccgatcccgatctcgtaaaaatagaatcctatacctgctcctgctgcagcgatgagggagaggaccgtacaactgtccggagttattttcattcggatacatgtggcaacaaccgggtcgatgatcggctttacctgctcacgatatgagtcaagggtcataacatgtctccgcatgagataagccagtcaacaattccgattgacggctgtgcagttcctctgattatttcctcaattttatctgcacattctgcaatatccatgtgtgttgtgtcaatctcgtagagcttctcctcatcatggatatcaaatgcttctgccagagtaacatccaggatttctgcttctatgttctcctggatcttcacttctgaatatccccgtttttttagtctgtccttgaggatacttggatgacaccgtaagataatgatccggtctgccgggaggagatgtgtcagatgcccctctacgatcccattaaccggcgtgaactctgaaacccaacgctcatcatcgatgatatcggtgtcccgatcaggatcttcaccaatacgatatggtccgaccgtatctgtagcataggtcaccgggactcccctcttctgaagttcccgggcaacggacgtctttcctgttccgggtgttccggaaagagcgatcatcataatcttctgaatacctcaatgaaccggttgttctcccattcttctcctatgcataccctgatataatgatctgcaagaccgggaaaactccggcatgaccgaaccagaaccccgttctgtgcaaagaagtctgtagcctgatcaccagtgagcggcgtaacatcaatcatcacaaaatttgccccgcttggaagaatcgtttttccgctctcctttgtaaatatgtcacgccattttttcacataggcgatggtccggtcgatatattcatggtcctcaagggcacctacagctgcagccgctgatatggtgttcagcgtgaacggggttgctgccttttcatacaccggtctgaaccagtccggaacaaatgcatatccgactctgcatcctgccagtccaaagaccttggacatggttcgtccgatgatcaggttatcataccggttcataagatcccggtagtccaccggtgaaaactccacatatgcgttatccaaaaagaggatgccatctatgttcttcaggatctcctcaatatctgaaaccggtgttactgtccctgaggggttgttcggagtacagaggaaggaaatctttgcctttctggctgatgcaataaaagacggaatgtctacagaaaaatcagggtttcttggaatgtgggtaacgtctcctccctgggcagcagctgcaagaccataaaaggagaaggttggagttgagatggcaacctgatcaccgggatttatcagtactctgatacaggtctcaatcactccgtccattcccacaccggtaacaaaggagtagtcaccgtgatatcttcgcagagcactgataaggtttgtatgagtggtatcagggtaccggtgcatggaacaaagggctttttctgcctcttttaatgcacggggtgatggtccgaaggggttttcattactggcaagcctggctacctctgcaaacccgaactcctttgcaatctcctctggcttttttgcaaatacgtaacccgtatcctgccggtagagatcacggatcagatcagcagatcgattcgattgctgcatgaatgactccgcatcccctgtcgatctcctcagcactgatgacaagaggcggcactaaccggagattgccatgtgcagcacaattgacgaggacaccgttttcccggcatgcctgctggacggccggacaggaatcaccgatggtcattcctgccatgaggccggtaatccgtatttcatgtgcggagagtgcttttttcatctgctcactcttatgtgccaccgatggcagtacctcattaatgacatcaagggttgcaagagctgcagcacaggcgacgggcccgccggcaaaggtgcttccatgttctgactttgagaactcaagaccgtcgcgggctatgattgctcccatcggaaatccgcttgcgatcccttttgccagtgatacgatatctggctggatcttttcatgctggtatgcaaaccatctcccggtccgtccgatcccggtctgtacctcatctaggatcaggaggacgtccttttcatcacagatctccctgacttcccggagatagcccttcggtgggatgatgactccggcttctccctggaccggttcaaccatcactgcggcggtatctttggtaattgccttgcggatgacatctgcatcaccatagggaacaaaggtgcagcggggatttaagggcaggaatggctctctgatggcaggtttgtgtgtgcatgccagagaggccattgtccgtccgtgaaacccgtcttcacaggctatgaactctttcttcccggttctgacccgtgcaagtttgatcgccgcttcattcgcctctgctccggagttggagaagaatgccttctttaatccagaatattcaaccagccgttttgcaagggttccctggtgagggacatagtacaggtttgaacagtgaatgagttctgcagcctgttcctgaatagcctttaccaccttcggatgacaatgcccggtgctgcagaccgcaattcctgcaacaaagtcaaggtatgatctcccttctgcatcagtgacggtgcagcctgatcccttcaccagcatcatgtcccggctgaatgcaggcatataatatgacgattcaagttctcgataattatcttcgtatttcatgatttctccaatggtatggttattcgtattctatcgttgcagggggtttgggggttacatcataaacaaccctggctacacttggtattgaggaggtgatccgcgattcgatctcctgaagatcctgaaatgatatttcaatgggatctgcagtcatcccgtcgcgtgaattgactgcacggacggccacgatccatccatggagccggttatcgcctttcactccggttccaagtcccaccagggccccaaggcattgccatggccggtatttctcaaccagaacctcctcgatgatggcatttgcctctctcaccacgtcgattgcttctcttgtcacctttcctacaaccctgaccgacagacctggaccagggaagggcatccggtgagcaatctcccggggaaggccgagcgcctctgcgacctcccgtacctcatccttatagagatcccggagtggttcgataacgccctgaaactgcatggtgaggggcagcccgccgacgttatggtgacttttaattcctccttcactttcgatacagtccgggtagatagttccctgcaggagatattgagctccggttgcggtagcctcccgctcaaagacacgaataaaacgttctccaacgatttttcgtttcttttcagggtcactctctccctcaagggcatccaggaactcatcagcggcgttcacaaccttcagacccagatgaccgaagatctctgatatccgctttgtttctcctttccgcataagcccggtgtccacataaattgggatcagccgctcacctatagcccgcgatgcaagttctgcacagacagagctgtctactcctccggacaatgcaatgactaccttttcaccgttcgattcttcttgtatccggtgaatggcctctttgatgaatttctctgtgtttaccattattctcctttccccctgttcttcaggcatgcctctacaaaacccaagaatggcggtgatgggcttgttggcctggatctgaactccggatggaactgggttgcaaagaagaagggatgatcttcaatctctgctatctccatccgattcccgtttctccctgaaaagatgaggcctgcatcctccagccggctgatgtatgccgggtcaacctcataccggtgccggtgacgttcgatgatctcatgctgccggtagagtttgtatgcaatcgtaccggattttatttcaaccggacagtcaccgagccgcatggtccctcccaggttttcaacaccttcctgttcaggcaggatggtaatgaccgccgtgccgtctccgcattcactgctgcaggcatcggcgatacccaggacatttcttgcaaactcaacgactgatagctggaacccaagacacaggccaaggagcggtatcctttcttccctgcataagcggatcgcattaatcttgccttcaatgcccctgacaccaaatcctcctggtattagcaccccgtcacattcccgaaggtctgcaggctctacccgctctgcatcaagccacctgatcgatacttcggtcgagagtttcctccccgcatgcctgagtgcttcctttatggacaggtatacatcttcctttccatatttgctgacgatgccgatggtaatccggtgggtatattcacgggtgacaatccggtaccattcagggtcagcaccatccttccgcagttgaagaagttgacataagacatcggccattccctccttttccagctccatcggaacctgatatatatccggagcggttgccgcactgatgatcccgttctgtggtatatcacagagtgatgagagtttcttcttcgtatgggagtttaacggtctctcactccggccaacaatgatgtcggtaaatattcccagctcacgaagtgccttgatcgagtgctgggttggttttgtcttcagatcccccatggagtccgatggcatgagggtgacatgaaccagagcccgatctgccgtggcaagttcacttctcatctgcctgactgcttcaaggaacggcatgctctcaatatcaccgactgttccaccgacttcaacgatgcagatgtcagccggtttcccgtcaaagaccttctcttctgcagcagatctgatacaatccttgatctggtcggtgatatgcggaattatctgaactgtctgacccaggtagtcaccacgacgttccttgtcgatgaccatcctgtacactttaccggtggtgatattatgggaggagttgagttcgatatctaagaaacgctcataattcccaaggtccaggtcaacttcaccaccgtcatgcaggacaaaaacttctccatgctgggccgggttcatggtccccgcatcaatgttcaggtatggatcaatttttactgcagtaacctggtatcctcggttttttaaaagccggccgatggatgctgcggtaataccttttccaagaccactcataacacccccggtaacaaaaatatacttcacgtgactcctccgaaaacctgcagaaaagttaacccttatccctcatttaccctgtgccagtaccctgcctgactataaaagaagcggtgcaccgtgcgagcaggttcccatctttcgcattagtgatggaggcttcggcataaatcattgttctgccttttctgaccacggtgccatctgcaaaaatggtaccctccctgactcccctgatgaaatgagtggtgcaggagacggttgcaatggtctctccttccgaaagcagcgtatagatagcaagggcgattgcctcatcaccaagggcggtgtataatcctccctggagccatccttcaccgttcttcatgtcatccctgaccgccatacttaaccgggcttttccatctccgaacgattcaggctcgatacccatgagacagaagaatgggtttgccttctggcccctattttttatctcattcagataactcatacatacatatgcatggtacaggtgcatgagattgacgataaaaatggggaatgcatatgagtatttcaggtgaacctgttagggtacgaactattcattctccagcattatgaatcatccatctgtcagtattgttatccccgcatataatgaatcaacgcgtatcaggccacttttgtcagaattaaccgattctgaccttgagtttatatttgtctgtgatggtaccgatgatactgctgatatcattcaggattacaaaaaaattcatcctgatctgagcatcaggtgcctgacatttccacaccggcttgggaaaggtggaggggtccgggcaggatttacagtcgcatcaggacctcttgtcgggttcatggatgctgacaactcaacgaaggtgtcagaactggtccgtctctcccgccgtattggagatcatgacggggtcatcggttccaggcaccttcccggtcaggttcttcagagaaaacaacccctgttcaggcgcatccagagcaggatattcaacggcctcattcgactcttatttggacttcccttttatgacacccagtgtggcgcaaaaatttttaagaaacaggctcttgatgcagttcttccacatcttcgctcaactggatttgaatttgatgtggaacttctctggcaattgtcaagaaaaggatactcgcttattgaagtcccggtcatctggaatgatactcttgattcacggcttcggctatcagatacactctcaatgctggtaacactcttccggatacgtttccatttattatcgtaagacaaaaaaggaaaaagatttttttcaccttggagaggaacgccttatccgaactgaatctgcatgagctgacagcccctctgcctctgcaatcgtctccacaatatccccaatcatctcaagaccctcacggtcaatcatctggatcgtggatgtctttgtgaaatgtgcaacattcagaccagagtagtaccgggcattacctgcggtcgggaggacatggtttgtacctgatgcataatctccacaagcaactgctgcgtaggggccgataaatatcgatccggcattcttaatttttccgagcagggagaaggaatcactgacctgtattgccaggtgttcaggagcgattttatttgctgcctctgctgcctggtctagatcctttacgataagatatcctgagcgctcaagagattgtgaaattatctctttccgatcagcctctgcagtcagtcgggcaatccacttccccacctcatcagcgagctgtgtacttggggttatgagcatggacgctgcaagcgggtcatgttcagactgggcaaggatgtcagcagcgataaagtccggtctggcatcctcgtcggcgatgatagcgatctcagacggtcctgccggaaaatctatctcgacggtatggcgaaccatcatctttgctgcggtcacgtaccggttccccggaccgacgatcttctcgaccggagccatactttcagtaccatatgccatggcagcaaccgcctgtgctcctccggtcaaatacacctcgtcaactccggcgatatcacaagcaaccaaagtcagcgggtgaaccggtgggggtgtgcagcatatgacctcctgtaccccggctactttcgctggaatagcacacatgagagcagttgaggggtaacttgccctcccccccggaacatagataccaatccgtgtgagaggggttgtctttacccccagggagatccccggctctgtttctgttatccagaagtcctcacggcgctggagttcgtggaatctgctgattcgtgcatatgcttcagataatgcctcggctaactctggcgatacgtcctcgtatgctgcatcccagtcctcttcgctcagtctgactgcttctggacggactttgtcgaacttttcagcataatcaaggagcgctgcatcgccacgagctctgacttccgaaatgatcgcctcaaccggccccctgacttcatcaagcgtgtctttctgtcttatcagccagttctcgagtgttaccggactccagctcatgggtagtacatggatgtatggctcaaaaaagtgatatgacagagcagaccggaatgggtgccagaccaatactagggggatgcaatcccgctgtcccatctccagatgtaaaaatcaggtgcaggacgcgcaatttttccacgtaacaggtcggtaagcattttgtaaagattcaggtagaggagaagtagttcctctgttttcccttcagactctgttttcagccggatcaatccttttacatactcttccatcccgtcacatgccgatatatcggctggcatgatatcagacggattgacattcctgacattgaatacatcatcaaccgagaccgccatttctgtttcactgactgctcctttgtggatgataagagttctccgtcttttattttctgccctgtccatgccaagaaggggtgcaatactgatgaccggtatcatctcctcaccccattgtgccatcccttcgatgtacgggggagcatcatagacatcgatggtctgaaggggacggacaaacttgtcgatgatgtctccatcaataagatagtgatcctttcccagtaatatctcaacgagtgtcagatgttcctgcatgctagtaaaatccgttctgttttttatcttatccgttccctgtatatactctttggtatctgtcttcttctgctgcaaaatatatccatatcctgaaccaacagtactcctatgatagaccgggcctgaatgtatgccggtcagtcccgggggtttaatgggatgacgacaaaaaatgatgtacttcatcggttattgctttttgcccttggggatggtctgtacggggcacaggtctcatatatccgcgagatagtgcctgaccaggtgaaaaatccccttcctggcgcaccggattttatcccaggtatcatacatgtcagatctgacgtcataaaggtcatcgatatcagaagaatcatcccgctcggaaaggaacgggccaaaaagaagatcatcgtcttcgtccctgaggatgcacacagtacgcgttttggtatcctggtcgatgatgtgtatggaattatggaggttcctgatgctgttgtatcccatcttgaccggtctgatgcaaaaattcagaataatttcatgctcgggtttatgaaaatttcacttgatacattcctgcaccagaatggacgacagttcgcggctggcgaagatgaccttgtctggatcgactttgaagatcttatccgtacgatcattgacggggaccaggctgattctattgtcttccgtctcactgctcttttcaatccgcaatatctgctctctggagaatggaaaaagaataccggaaaaatgaaagcataagggattagatcacaagtttcagttttgagtcttttcctttcaagattcccagttttttcatgtcattgaggaccgattcaatatatgccggcgagaggtgaaagtcgatagtgagtttatcattttcaatcggcagggtcttatggataaattcagacatcaggtgctcttttgatgcccggccatccttttgaataatccccagaatctctccgactaatacctgtttcacctgaaggttggcgaagaatttatctgtttcctcctcattatcagtctttttgaagtactcttccagttctgtcagatcttccaggtatatgacgtcaggccctgtggtgacgacataggtataggtttgccgtgcctcaaggctccggatgatctcccatttttgtaatgcctcctccctgaatgggggaatttcatcaccgaacagggacatgaccgcgtcatcaggagagatggtacgtgtcagaatcatgccctcctcatctatgtcaaggagattattgagccccagaatttgtgtaactgtggcttctcttaaaaatgcctccatatcttcttcggtttcaggcatctcaccgtcactgataaggacattgaaaagcttcgtgttgatgtgatctccaggtttatggctgataaatgtctgctccaggtagtttctttcagtgatgagatcctgtaaaccctcttcaaaggcctttacaaactcttcaaatccttcctccccggcatcacggatacgggctatctcttcttcaaaaactccctttaacgctctgaagggtgctttgtataacaccctgctttccagttccaccttggtcttcagactggcagagatgttcagatttcgaaaaatctttacacaaccctgtgcttcttcttccgaagaaaacaagatctcttcttcaagtaccatgactagcacatacctcagcccggtacctgatatgttagctggtcggtgggaaaaaaaggatttattcagcgatccgtttgagaagccaggtcatattgaccccaagggtctccatgcattccaaaccttcctcgtctgagtcgacctcccctggaagccttccaaggcccatgttccagtaggatgatccgggcactatcatctgacacatcaggaacagatggttgatggtatcaaacgcatggatggctcctcctcttctgaccgatatgatcgcagcacctaccttaaatttgagaaagtcaccacctgacctgcttaacataccggtcctgtcaatgagagccttcatctcggcggtgacgtctgcaaagtaggttggtgacgcgaagattatcccgtctgcctcccgcatcttctcaacatattcattcagatcatcggtctgatttgcacattgtccatttctggtttcgtaacatttcatacaggcaaggcatccatgcaatggttttccaccgattcgaaccatttctgtctctatcccgtttgattccagaatatcaaagacacgacggaccaggtgctccgaatttccatccggacgggggcttccaagaaatgcaactactttcataaatcatacatgagtgagggagattgataaaatccactcagggatttttctatgctccgtcttagaaaaagccactcaaagatccgaagaggataccaaatgcaatgagtgccacacctgcgaagatgaccgggttccagctgaggatcttagccccgtccagaggtccgactgggagtaaattaaatgcggcaatcatcgcattgactttgacgcccacgaggccgatgatcgcaagtaaagctgaccctgctgactgaccaattactatcagggcagcaaagggtattaagaggatgagattgctcaccggcccggcaagtgatatttttccattctcttcccgtgagatataatttccatatatcatggtagctcccggagctgcaaagacaatccctgcgagtgcagccatggcaacggcaactaccagcatcatactgttcatctgaaattcagcccagtatccgtacttcattgcggtaaatttatgggccatttcatgtacaatgaaggcgattcctgctgtgacgagggagattataaagaactgtccgataatgaatggatcaagtcgctgcccccacaccatcgcgagggtaaatgctgcagaaagagcgagccaggcaaccaaaaggtcacgtctttcatggggggggattttttcccatatatacatggcatacatgtatgttgtaatactacaatggtttgacggataccaagattcacatttacaagattgcttcagtggattaatcctgaataaaaggtttcattatgtgggtgtaaaaatatccatagtaaaattatcaatggaataaattggaaacaaccagtgtcgatcactattctgataatattttcagggattctttatttagcgttgggcatactccagaaattcctgaaattcgatggaacgatgggaaaggttcatacattatctgtggtgatggactcacaatattggaaaaattgcccgattcttttattcaaactgttataacgagtcccccatattatgggatgagggattatagaatccctggacagatcggtgccgaaaggtatcttgatgattatattgcccatcttgttgccgtattcagggaggtgagacggactcttacagacgatggaacgatatggatcaatattggtgatacctatacaagtggtaaccgtaaaaccagggattctgataagaaaaatcctgcccgaaagatggattataggccaccaacacctgaaggtctgaaacctaaagacctcattggtatcccatggagatggcccttgctcttctcgaagatggttggtatctccggtcggacattatttggcataaaccaaattgccaacctgagtctgtaaaagatcgtcctacgagatcacatgagtatgtatttttgctttcaaaaaatgaaagatattattataatcattctgttatgaaagaaccggattcgaaaggtgatggccttcgaaatcttcgtacagtatggtcaatacatactgttccgaatgcgtatgatcattccgcaattttccctgaaggattaatagagccatgtgtgttaggtggatcaaaagaaggtaacattgtacttgatcccttttttgggacagggacagtagggatcgtaagtcgaagattaggtcggtgttttctaggaattgaattgaatcccgattttattaatattagcttgaatagattatcccaacaaacactatgagtgatagatctcttattgtactatctccagaccttcagttttccttttataatcaactaaagataatttctgaacagtatctttccaaagctctcactgatacgatattgaaaatggatattgaaagaattgacggggaattactacagcttgtatcaaaggataaaattaggaaagttgcaggttggggtctgcgtggagaaagaattttccccataccatgtattttagtggcaaatccgtttttattaggctattatcgtttattatttggtttttctcaaaaacagttttatcaatcgaatatttttggtaaatttggaatattctcatcccatggcatgagcttttataccttaatcatgaaattatttcttatcgtatatgaccgcctgtatggcacattgcagtttcgggttgtatcagcttacctttcgctgatcttataaggtaaatgttaaattataaagcttaactttatatctgagaagtgtacatatatatgggatgatcgctccgacacatcaaattgaacacatcggcggaatcccatatatctttgaaacattaaaagaacttcaaatcatacgaattttgaatgaggtatattcgcctcacagaaactgggtgggtttgccgattggtgaaacgattgccatttggatctgctactgcctgaccgaaaatgatcatcgtatgtgtcccttggagaagtgggttactaccaaaaaaaatttactggaaaaattgattggttttcaatttagtccaaaatgctttactgatgaccatttggctcgtatattatctctattgcacaataatgaactttggaaccgatttgaatctgaattaaatcgttctacactgcgtatatatggtttaacggatgaaaacatcgtccgtcttgatatgacaacagtaaacagcaatggaattatcgataaaaacggattaatacaatttggcaactcaaaagatgacgcctccctccctcaaataaaaatcgtactttcagtgcttgatgtgctgggtttgcccctcaccgttagtgtagtccctggaaattgtgctgatgatcctctctatatccctgcaatggaaaaggtgaaaaaatctacgggacaatctggattactttttgtgggagattgcaaaatgggtgccatagcaactcgtttgtatacgactatcaataatgacttttatttatgcccgttatcagaagtctctcatcctactcaggaaatttattctgcaatcatagcacatcaggagtctaatctttccttcacacaagtttcacgatcgtactatgatggaagcgatgcgattatagccgaaggatttgagaaaaaaatatctcattcaatggaatatgaggggaaaatcataacctgggaggaacggctaatctacgcaaaatcatttgctcatgcaaataaattcagattatcacttgaagagcaagtaaaaaaagctttctttgagataaattcaatgaataaaagaggaaagggaaagaaaatttaccgaacaatcgaggaagcaaaagaaaaagtacatgctattcttggagataagggattaacagcggtattcgaagttgagtatatcgagcatattagtaatactccaaaacgaaaatacggaaacaatcccgccagaattgaacaatcgacgagaattgaggttaaaccaactattaacttgcaagcccttcaacaagcgcaggaattatcaggatggagggtatatgtaacaaataaaccagaaaatgaattatcgatgcaagatgttgttctgacttaccgtgatcagtatatcatagagcatcaatttcatcggctgaagggaaaggcactttcacttgccccaatgtttattcaacgagatgacagaattgatggtttagtgaagtttttgactattgtaatgagaccacttgttattattgagaaaaaagtcagggattcgctgaaaagtagaggtcagggtttgagtggtcttttcgaatataatccaacgaaaatagtaaataatcctaaaactgaaagaattattgagtttttcaaagagatttatttgttagtttcattttatggtgaacaggttttttacacaattactgggataaatcaaaagcatcgagagattttaaatctgatgaatgttgatattagtgtttatactcaattgggatcaattcaggaatctgaatttaagatcagcgaacggtgagatcagaataaattttaattaattgcattggtaggggatagataatgagatttacaggtcttgaagaattgctcaaagcagagataggcgaagatgaaaaactgaaaatacttgctgcacagtatatagaacgcctgaaagagcagaaattactcctggattctacacgcatcctcggagatacatcactcagtctcaaggatgctatccgccgtgtccttcgggatatcccggatgcattccagtaccctgagatctgtgaagcatcttttgaatatacaactctatctcaagaaagggacattctcagtccggctgacggtaaacagaggcggacaggcaagtacggtttataaacagcggttaataaccgtaatataacttttttcagcaaaaaatcagagttgtatagaagcaagtgcttcttttacttttggtctccaggattcaaatggccgctgatatatttcagcagctttctgatgatcgggatcgtcattattcttctcaatccggtccagcgtaagccgggcagtatccagaatccagcagtcaaccacagttttatcaacggcggtaatagattctgccctgattgataccaggtttctgccatcaggggcctgaaacaccccaggctttccaataatgactacataggatggtgattcgatcgatgagatctgatgaagcgcttcgggttggtagctcccggcactcacaaaaaagattccggtgggatccatgaccctgatctgataaaagaccgcctctccttcagacttcttcttttcagtcagagttccggcgatgaatacacgattacaccgttctccagttggaagcagtatataggtcgggcttttgtcatccgtcccttctctgaaatgatggtgagcttcccgaagttctgccgcaaagactcttttcgctgactcgcgttcaaatcttcggtttgctgagttgtcactcatgtgatccaccctccgcacggttcatcagttcggccagcatcccagcatcaaaagcctgaaattcgcaattataggcaaccaggcgattatcaaacactttgccccggcagataagataccgccccagaatctgttcattgacatgataaaatacggtatcaagaccaagagggttattctctgccatctcctgtgccgtgatgaggtttaatccggtcagttcttcaacaccctcccgtgaaattatcgtatcataggtcttctgaccgtcatcaagccaccctttaaccctgagatcatagatataattcggctgaatttcatggatcggacaataattctgccttgagaggacacgaccacatccctcaaccggacatcgcttgataagacctgatcctggagacaggtggacaaatgccccctttacttcctcattcggagatctcacctgaatagtggcgccttcgtctggaagaagggttgccccgttcagggttacagataaccggccgttgaactcatcaactgatgcataatagatactatagaccatgtccggtaccagtctctgggccatatcatccttccaggtgacgaaccggatagtccccgactcatcgcccaaaaggccgctctggaagatgcgttctgaagtattttcatattcctggacaagttttacccgcagacagacgattcccggccctgcctgggcgaccggaatgatatttggtctgatactccggtcctccagaagtggtgtcgctgtaccaggatttatctgcatgcttaatgccccccggtaccgatccacaactgccccctttattgcgtaccactgattttccatcaggggttctgctcccggactatttcggatgataaacctgaccgctccggaatcatcagcaaaaacaccccgttgaagtatttgatcagaatattgcttctcaatcgccactaccttcccctcaaccagggcgacaccaggtgataattctccaaccggggtcttttcgatgtcaggcatttcatctctggatatgggggtgatttttgtcccgctatgaatttttattgataattgcccgttaaactcgtctgattcaacaagatccagccggtaccagtgcccttgttcaaggagcggagcattggcagaggcccaaacggtgaaccggatagtacctgaattatctgcaaatattccagactgtgcaattgaaggagaccggggtggaaagatggttgtgacctcaccttcaacagatatccattgttttggttttatctctgatagcggtgtgatcaccggttcaggaacagaatccggagaaagttcagttatggtggttcccgaatgaactttcagacttacctgaccattatattcatccgctaccgcagattcgagcctgtaccattttccctgttccatgaccggtgcatttgcctttgcccacacggtaaaccgcatagtcccgcttgagtccattattaccccgctttgggctactgatggagagcgtgacgggattaaggtaactatctgtccttcgaccgttacccattgttcggcctggatctctgatatcggtattacagaatcagcatcctgttttgacggacctgctgatggaagttccatcccaaattgccgggcataatcaccaattattgatcgttccgcttcggctggtgggacagagaattcttctacaaaccggttgatcttttcctcaagttttgcccggtcaattggatgacctgctgctgcaaatttttcggagatcctgtctgcgatttctttgagttccatttcatctccataagaaaggtcaacaacaagggtatttaaagaagacacccgcggggtgaaagtgaaaacatcaataaattatagatattttagagagttttggaatataaagactttaattcaagtaaagtggcttcaggatttctcaaaagatggctggttaccaatgggtggtgatttaataaacagcgggtgcatgcccagaccggtgcccgttcagattttaaaatccaatcaccaagggttgtatctccacacgggtagagcggacagtaacacagatcacatcgctgcccctgataatgacacggataataggggcaatgctctttctcccataatacccagtgaggtccgccgatacctgaacggataaaaaatgagggctttttcttcttcgtatcagactggcgaagcagagcttttgttacacctgtatacactgtttcatgaatccgctgtccggtttctgttgcactccctgcgtacctgatggtcccctggccttcagatgcgatgatgaccgcgtcagtgaccgttcctgcaaaatcataaccggcatcacgaagagcgaggacttttgcttcggtcgtagtaattaccgcatcgaccagagcctgatcatgaaaatcccgggtcaggacaataatattgatcgtcccgggagcaggatttggtacatcctccgatgccggtactgatgactgcaccggatcagggtgggttatccctgccgttacaaagaccatcatggtatcccaggaaagaatacagagcgtattcatatcaacagccgtcagaagaccagcagtgtccgtatatgaaagacccagagaatatgagagcaactccagctccttctccggatcatgagaaaagtcgttttgaacctgatgatttatcagcgttgtacaatttcgaatgccaccatgaggtccggaactgcagattcgaaacttcccacgtacgataagggaatttgatctgaggaaatacctcatgtgatgctataacgctgacggtcttttaattcctgttgtttgcctgcattccagccggacacgtcctgcaggtatccggtaaccctgctaatctgcacaacgtcatgacatccacattcagggcagaccggttcaccacagagcgggcagtattctattgttgcagcaatctcatgtgaacagtcacagttgtcaagggggcacatgatctccaggttcacatcaccgcagacaggacacggactttcatcaacaatcaggtggcaggtgtgacatttatatcttcgttcactttcagggatctcctccttgcaggagtacttctctgaaagagccagttgttccttggtccagttcatactaagtgattgcctttcattcccttaatggatagggaagatgagggttcgttccgcgaagacttctgaactgtgcatattgctgcgccgcaccggcaggatctgcagactcgtaaattgctctaccaacgataattccatccacgattcctgctattgctgatggatccccgccctgtgcaccaacaccgggtgacaggatctttctggtgccgatgagagtgcgcaacatctgtgtccgttcaggtcgtgtagctggagcaataatcccatccgccccggtttcgcagacaagtgcagcaatccgctcggcaatgcccccatggaaaaagtctaccgcaccaggatggctcatctcagtgacgacatagcactctcccccatgatcatgagcagtatctacacaggcgagcacagaatccctgccgacaaagccgtgacagataattcctgaaaacccatgagaaaaaacttcctcggcgataagccggcttgtattaggaatatcagccaccttgaaatcggcaataaggggaagtcccccggctgataattcgtcagctatcgtaagacctgctgccagaaccaggggatagcctatctttatcgcatccagatatggtccagtcttctctgcaatcgacaccgctgcatcacgggtgcctacatccagggcaaggattacttcggtcatttatttctccagaactgctgacatgataagtgggaaggttatcgttgcatcaccatacaccgtaaccgtctgtgcatcctcgtcaacctttccccaggatctggcttcatcaagagtcgcaccagagagaccaccaagatcaggccggtctccggtcagttgcacggcataggtaaaaccttttggtgtcatgagcatgctctggaggatataattcttcggaacaccgcctccgacaaagaacgcaccagcgatgtctgctgaaaaacaccggtccatgattttatccatgtcaccaaatgcgtcaacgactatcttgtgggtctgacggtataaccagaactgcagcccaatcatcgagtcctgaactgcaggacaaaacaccgggatcttctttctggccgccgtcgcaaggatacctgaattgaggtgagaaccgatatgggcaaggagatccgtgatcgatatgacggtaccatcaggaatttttgagaggatgtcctgcataaactcctcaaattttatgaatgaatcattcgggagatagacatcataaatccggttaatctcatcatgccgcagctcaatatcgttgcatttctccgttccccggaaatgatggcatccgattgcttctataatatcatgagtcaggttggcaccggttgacaccagaacatcaatgtatcctgcttccataaggtcagatacaataccacccattccagcgggaaccatcgctccggcaagaccaaaaaagcgggttacccgtttatcctgatacatcgtaccggttatgctcaccgcccgtgacagggcaccaccattatacgctccagcctgctccatggcactgatgagactttttactgtcatcccaggcttaagatggacctgtcgtaccggcacatcacattccatactatatgtatgggtggtcaactcccaagtacctgacgtgcgaggaaatgcgatcccaccaggtgaaaatcagcaccccttcttccgtgatgagggaaggtaggaaggatgaggctcaacataaccccggacaataggtcgtgagagatgacgtcgtgctccggggggaacttcgtaccagcctgaagagatggtccgcttttcaatgatgtgttcagggttggttgtgcgattcccgcaccggcggcatttatacccttttcctgaccctgcactggtcatccgcttctgacatgccgggcagatgggtgcccgtactgatatatatggttcagcagagaatacgtacatcttctcaaggttcagggtatttttcaggtaactcccggccaccaggatctcatcaccaggccgtaatgatcggacaatatccctgaatttcttcgtcggttcaaaggccatacagtgaatctgatgatcacaaatcttgagcgggaaaatgacatggccgccttttccggtttttggtgtaccatgaaccctgcccctgatcaggtatgatatcccttcagtcagaaggctccctgcataaaagaccaggtgtgcatcagtcccctggtttgtcttccagatacgagccagatccgctccttctgatctgaccatcgacactgcatgggctacagaaaagggagagtcacccctgataccaaataacaccggatccggtgtatgagggacacagaccgggcctttcatatccgtatcccaggtatcccaggtgtgaggactggtctgttcctctgataatcgaagactctcggcgtcaacctgacggggagtatacagccgaccgggatgccggtatgccagatactcccaggtaaaatctggaaactcactacacaccgcagcagtcgctccaataagacctctcccaagtttataccctagaaatcgcaatgcatatctggcaaggaaatccctggcttcatcaatcctgcaatgactctgaaccgctttccagtaaaaatcagcgggtggcttttgaagaccgaccacaataccgggatgtgtattctcacaggagagcgcagcgaacttttccacaagacctgatgcgatgctgaatgcataatccggatcgcctctgacacaaagagagatcgcagcatttccgcgtgttttatagggcacagtcgggttgagtctgaccagtctggaagaaaataccttcattcctgacttttcaagaattgtggccagcactgctccaagccaggtcgtacacattccatccggagcatccgtatcatcaaggccaattaaaaaccaggtgttcgtcatcagcttttcatccgtatatttctgcaaatctcatgcaaatcagggagcatccagattatctgctaattatgaatctgcgcaccaaattccttatgtacaggaattatacaagtaccttctacggtacatgtcccaggatcgtctgctccgtaatgtcatcagtgtgatgatcatggcaggatatgaagtatccgaagttttcgcaatgagaccgaagagttttgacatcattgcaggaaatggtgaacggatagtagtcctgaaagtcatctcacatatcgatagcattagcgaagagaatgcacgggatcttgacagaatcgcacgtaaccttgacggtactccccttatcgtcggtgaacgggcccgtgatgctgaacttgaacgtggcgcagtatatgtcaggtacggaatattcgcgataaattacccgaccttgcatgattattttgtagaagattcccccccgctcatttatgcatcacccggtggtctgtatgtgaatatcagcggggaacggctgcgtgaacttcgtgagaccagaagcctctctctcggagacctggggcagattctgggtgtttccagacggacggtggcaaaatatgaggcaggcatgggaacaacgattgagatagcgctgcgtatcgaagagacttttgactcaggagtaatcgagccgatcgatctcattcagtcaaaatcacagttcacaaaacctgaaatgccagaggttccggaggagataccgattcaggctgcaatagaagagatgggtatgcatgtccagcccatgtatcatgcaccatttcaggcccttgtcaggtatgattcacataccatactcaccggatatggatcggcacaaaaagtcgcacgacgtgccgggatcattggcaacatttctcaggtgacgcggacacatgccatgtgtgtgatgaccgatgatcagcgacagcgcagaataggccgtaccctgatgattggtgaggattctcttctttctcttgatgagccggatgatctcatcaatctgatcctaaactgatatttttatatagaaccactaaacaaccttatcctacaacgtggtgatattttatggctacacaacttggaggacagccaattctcatccttaaagaaggaagttcccgtacccgcgggcgcgatgcacagggcatgaacatcgccgcagcaaaggccgttgccaatgcagtccggactacactcggaccaaaaggcatggataagatgctggtcgataccatcggtgatgtcgtcattacgaacgatggtgtaaccattctcaaagagatggacatcgaacatcctgctgcaaagatgatggtagagatcgcaaagacccaggatgatgaggtcggcgatggaaccaccactgcagtagttatcgcaggagagctcctgaaacgctcagaagaactccttgaacaggatgttcacccaacggttatcgcccatggataccggatggcagctgagaaggcacaggaacttcttcagaagattgccattgatgtcaagccgagagatacaaagatactcaagaaaatagccgagaccgcaatgaccggaaagggcgcagaagcagcaaaagaaaaattctgtgaccttgtcgtccaggcagtcaccatggttgccgatgatgatggaacggttgacactgaaaatatcaagattgagaagaaagtcggtggttcaatcgaagattcagagatcgtcctcggaatggtcattgacaaggaacgtgtccaccccggcatgccagaaaaggtcaccaaggcaaagatcatgctcctgaacgctgcagtcgagttcaagaagactgaagttgacgcagagatcagcatcaccagccctgaccagcttcaggcattccttgatgaagaagagcggatgatcaagtccatcaccgacaagatcatcaagagcggtgcaaaagtcctcttctgtcagaagggtattgatgacattgcccagcactaccttgcaaaagcaggtatccttgcagtccgccgtgtcaagaagtctgacatggagaaactcaaccgtgcaaccggtgcatccatcatctccagcattgatgcaatccagggatctgaactcggatatgcaggcttggtcgaggaacgcaagatctcaggcgaagagatgatctttgtcgaggaatgcaagaaccccaaggctgtctccattatcattcacggtggaactgaacatgtcgttgcagaacttgaccgtgcttttgaagatgcaatccgtgtcgtcggtgttgttcttgaggacaagaagtgtgtagccggtggcggagctccggagactgaactttcgttacgtcttcgcgagtatgcagcaagtgtaggtggccgtgctcagctcgccatcgaagcatttgcagcagcccttgagatcatcccccgcactcttgcagaaaatgccggacttgacccgattgatatgcttgtcgagctccgtgcagcacatgagaagggtcagaagacggtcggtctcaatgtattcgatgcaaagccatcagatatgtacaaggaaggtgttgtcgagccgctccgtgtcaagactcaggctattgcaagtgcagcagaagctgcagtaatgatcctgcggatcgatgacatcatcgcttcagcaaaatcagcagcaccagacatgccaccaggcggaatgggaggcatgggcggcggtatgggtggaatgggcgatatgggcatgggtatgtaaatacccccataccaacaaaacactcacccaaaaaaattaaaataattactcatgaagggatgacgacgtttctgtcgtccccgtcagaatttttttcacgtctacccagataatcagtcttttttctgattcatgttcttctgaagaactttcagccctgatcccttcttcttcatcgagtttgataataccctgaatataatcggtcaggtgttcatctactcccttaatattggtatcaatggaattctcatcaatagtgaggacactgtgaacctcatcgacgattacaccgacactggtattttcaaaggcatccggaataagtaccataatcttctgctcttcccgcttcttagccggtgtgatgccaagaagataatgcaggtttataatggtggtaatctctccccggaggtttaagagaccagtaacatgggagggagcacggggtattggtgttattggcagcatctccacgatttcacgtgctatgccgatatccatggcatataattctccccctaactcaaattccaaaatatctacaaccatacctgaagattgatctattcttcaggggtttgaacttttgggaatgcaaaataatgacaatacgtgaacccgaaaacagtgatgaatgctgacagtaattaatcagggaatgtgtaaatgcaggagaataacacctgcctgtatgtgctgaaccaaaccccccggatatctcatgcctgatatgttcacacaagttccctgacaatatttcattcttttatggccaatatataaaccttcgttactattttttaaaaatacagaccagacatcggataattgatcttcccctatcagatatgaaaacacagaaagggggtattattagacttaaaattgcatttaaataataaattgaaatttttatgatgaaagcatctttttcagaatatataagaatagtattataagtaacttacagatgattcaaaacctgacaatttccctgataactgataatacgcgcagataaacataataattcagatacacataatgactcttacggcactagattcataccatctgaaaagttcaaaaaggaacacttttcatcttcacagagaaaggagtattattcataatgatgacaggggctatctcaaaagggatggattatggctggaaatccaattaaggtattatttgttgaggacaatgaggatcatgccttcctaattattcatgaactgaaaaagggaggatatgatcctacattaaaacgggttgataccatagaagatgtcaggtcttctctggattcaaatgagtgggatgtcgttctctgtgattacagtctgccagggtttaatggtgtggatgttattgaggagtaccggaaaagaaaccttgattacccctttattatcgtctcaggagagattggtgaagatactgcggtcaccctgatgaaacgcggagcacatgattatgtgttcaaaggcaatctctccccgcttgttccagtcatcgaacgtgaaatcagagaggctgaaaaccgccataaaagacgggagattgaagaactgcagcgtgcagaggcgataaaattcagggctatgatcgactcctcgtatgatgccatcaccctctttgataacgatacccttattgagtgcaatgcaacaaccccgaagatattcagggttcctgactcacaatccatactgggagcctcaatatactcactcgcccctgaaaaccaggcagatggttcatcatcgagaatcttttttaacaaggcttttaccgctgcaaaacagggcatcccccaggatcttgaatgcatcctgaaccggtttgatggtacatcctttgatgtcgaacttaccctcacattacttaccctccccgaaggcccgagaatccaggcaaccttccgtgatatcagcgaacggaaaagagcagaacgtgagatgcatgaccagatggagactatcaaagaactccagcagcaggagatgaccatgatcaatcaaaacccgctcccccttctgctcatggacctgcaattgcacattctgaaggtgaacgcatccttcattgagatgagcgggtacaccgaacagcagctcctttccatgcgtgccaatgatttcaaggtacttgaaaaaaccggtcaggggcttcgtgatgcattgaagtcaaaaaaagcagtaaccggccaactcatcgtggaatttccggcaggcattcaccatattgaacaagatatcatcccacttcttgacaagcaccacgaagttgtcagtatcatgtccacatacaaggacaagacaaacgagatcaaaaaggaacaggagattcagcgtatgattaaggaggcagaagagcatgccaacctccttgatcttgctgcaaaagatatcggtgaagcgtttgcccttgtttcaaagggagacatgacaactgaaatattaaaacgtgagaatgatccgctcattgccgtaaaagagaacgcaaataagaccattgcagcccttcggaaggcattgcaggaggtcagcagagtttcaaccagtgtttcggagaacatgggggagattagtaaaggatcatctgacatcgcgagggcaacccaggcagttgccaaaacaaccatggagtcttcagaaattggtaagaacctcatcgcccacatggaagatatcaccaacaaaatctcaaacctctccgcctcgaatgaagagatcacaagtactagccaggaggttctccgtcatgccagagatgtcgcaacacggggaaatgaggcacagactcttggtaatgaagcaaacaacaagatgagtctggtgatgaagatagcacaggagagtgttgaggatattgatgaactcaactcgcagattcgggagatcaataagatcgtcaagatgatcaatgacattgccggacagatcaatctgcttgccctgaatgctgcaatcgaagctgcacgggcaggagatgcgggaagagggtttgcggttgttgccggtgaagtcaagaacctggccgctgatgcacggaaagcaaccgaccatatcggcgatgttataaccgccattcagagaagcagtgagaagacatcaacggcgatccgatcttcccactccgagattgctgtcggcgtggaaagtgtgaacaagaccatagagtcactcaatattatggtcagcggggcatcagaagtgaccagggacatgggagagattgtcagagcgatagaagatcaggcaaatattgccacagccatcgttaacactgcccaggaagggatcagtctgacaagtgagaaccttacccagatagaagaactctccgctcttgcagaatcagtcagtgcctcagtccaggagatcaacagtgctattattgaagtcgaaggattgtccggagaactccggacccagattcaggcctttaaaatataattaaaaaaagttctgggtggcataataatattcaccatcaaatgccaccccaattccgattttttcgtgagcggggaggagaagtgcctctttatgcggcgggctgtccataaaggattcaatggccacctgtgcaatctcataggggtcatcatttctgatctccccaaatccgtacacatccttctcaaccgggatcttcacaatattctctccaattccgtaaaacgatgtcccgtccggcagcgtccgggactgatcataatgatggcgatctgcacgatctgcagggtcctcaccatccggattggtatgatcaaaaaagcccctgtgagccatatctttgctgtgctcgagagcgatcacatccagagcggtgtcacgggtaagtgaaggcaggtcccggagggcccgttcatcattcgagagaacaagaataatctctgcaatcttttcattgaaccagtcctgtggccgggtatatgtcttcccaatggtaacggtcccctgtgaaatgacatcattctcaggatggggatcaggagtaagggaaaaacccggtcccagaattgcccctgcgatatactcccccggaggaatggtatctggcacagttgccaggagttcacgatgggcagtctctccaggcctgaggaatgagaaatgcaccgatcccaactcataatcagccggtgtaattttttcatcggaagagagataaaaagtcacttttctgctcatcgagatcatctgaccataattgactgctgtcacacttccaaaaacggaagagcctggagcagcagagggttgaacatcgattgaaagcagtccgatatctgctgctttttcttctccggccacaaaacacgggatagtaagaagcagaacacagatgaggaaaaaacgaaatatcagtatgaaatcacccataaaaacctgaagagtttgctgaaatattgtctgatctcaccatcattagtgtttctggtctcttaaaaccgaaaccaccgcatcatcacaatggcatcttctgtgtcggcataatacccgcagatctgaaacaccggttcgtacccgagttttgtgtaaaactggatggcagaggtgtttgagactctgacttcgagctgcatggctgttgctttctgaatcattgcagcctgctcagctctccttaccaacgtcttgccaataccccgatttctcatatcaggactgacagcaagactacagatatgcccataccgctcctcaccggtgtcctcaacaccacaaatgatatatccacatattgtgccttccaattcggcaatgaaaaccgtatctgaaaaggttgtgatggcttcctcaagtgtctcacgcgcccaggggtcaggaaaagaattccgttctatcccctgtactgctgtaatatccgccaaagccatctttcgtatccggagacctctttcctgcatcaaagcctgtacttatctgtcagtgttatcatatagaaacaagggaatataggtaagaacacctggtgtcttatggttcatgtatatccatttcaagcagtgcggcctgctcctggaaaggcagaagagattgctgccgtcccgtatgacgtcgtgagtgccgaagaagcacgggagataattgagaagaatccactcagttttctgcggataagcagagcagatgcacttctccctgacaaagacccgtattcagcggaagtatataaactttcacgggatatatttgatgaatactgcaattccggcctgtttgtccaggatgagacggctgcaatgtatgtgtaccgggttcatgacgccggcagaacatataccggcattgcctgctgtgctgataccagggagtatgagagtggtgagatccgccggcatgaactgaccagatatgacaaggaggaagatcggaccaggcatattgatgccatgaatgccaacaccggtccggttgtccttcttcacggctctcatgctgagataaaagcgatcctgaagaagtccactgaaaaccgtgaaccagatatggtggcacatgccgctaacggaagtgtccatgaaatttttgctataagggatgaagccgttcttacccggcttcatgagatttttgtctcaatcccggcactctatattgctgacgggcatcaccggtgtaaatcagcagtcaatattgttgagaagagatcagagggaggtgtaaaggtccctgaggagacccatcacgttttgtctgttatctttgccgaggatgaggtaaaagttcacgggtacagcagattacttactgatcttgcacccctgacaccagataattttcttaaaaaaatatccgatattgcacatgtcaccccctatggtgatgcagaccggtcccagtttaccctgacaccaaagattggcggagaaggcgatcatgtattccacctgtacctcaagggaaaatggtatgaatgtgtgatcccccgcaacccgaagattaccgatatcagggcgctggatgtgagtgtgcttcaggaacagatcctgatcccattccttggcatcacggatccgagaggggatccacggcttcagtaccttggtggtgcccgcccggttcgtgacctgatgataaaagtagacagcggtgagtatgcagcggcaatcgcgatgcaaccggtcgatgtaagaaccgtcttttctatcgccgatgcagggggaatcatgccaccaaaatcgacatggtttgaaccaaaactcctaagcggactacttgtccacttacttgaataaaaatttagaagttttatcagatttccgctgccttgatggtataggcggttggcggaaccgggattgtgatgttcaggtcatccggagccgtgacatcggttgcagatgcgataaatccatcatattctgaggtttttatacctgcaattaccatatcctgaccggtatatgatcgtgcagtcaaatgataattcccactgccccgcttcccataaatctttacatagtagagtttctgttcatccggatgtgatattccgacatatgcattacttccaagcccagtatctgcagtgattgcaacacagggtttgtatttcggattgcatgcttcatagacatacagatcaagatccggaccacagttcctggttgtgaacatatcaacatcagacctgctctgcatcaggggagcactgtcatcacaggggccggaaagcacccattcaacaaatgaacggttaccggtgagccggtatgcaaatgtctttgattcgcctgcatttaaaaatccggtctgcaggttatcccggtacaccatggccggagcacaatcagccatattatagcagggtccgccataacaggaggtcgttatcggacattccttgtctatcgcaagagtatattctgcaaaccctttcattgattcgacaacgacaaaccactccccggactcaagatgtatcttctgtgatgatgctggtgacagggtactcacatctgcattcctggtcacatgaatcgcagaaggtacccaggtacttgaggcttttttggcatacatggaaaattcactcccctggtccccggatagcgtgagggttgcggtgcagggaacattgatggtatacatcttattctgtcctgcatacagggcattggaaaatgattcggatgacgccccacttaccagacagggcagagagattaaggcaaaaacgaaaagtaaaatgtaccaatttttctgatatttcatagatgacccatccagctcttcctgtgtgatcttgagcatgatggtaatgaatcttaccaattaaagatcagaaaaaaggaaatttattgatctgaaacctgcacaaattcagccgtgggagcctgaactgacgaagatactgctgtatctaatccggatccgctcccggcactcgaatatgcaacggtagatgatgttgccacaaccggtgctgatgccacaataatcggcgtatctccaaagcacttgtaactgttcatccgtaaattataggttccactgccgctgcgtgcatataccatcacatagtaggttgaaccacgttgcgggtttgagatggacacataggcattcggaccgtttgcgtagtaattggtattacaatacgagtactgtggattacagtccttaaatacatagatgtcaaagttcgggttgaaaccgctaccgctgaagacctgtccggccatggaagagacgatgatcggggtcggaccgctgcctgatccggtcaggatccattcgatctgtgaccgcccatcggtcgggatgtagtatccatagactgctgcttgtcccggatacaggaatcctgaacgatcaacggtcttatagggactgcatggtccgggaaccggaaccggtactggtggagatggcggaataggtcctggcgggaagcagttgctgtctgctgtcacatatgctgttccactgccagaccgtgcatacaccacaacgcaccagagtccctgatccaggtacacggttgcactgccaccaaggccgctgctgtaggcatacgtgtcataatgactcatgatgtaattattcgaggggcaggttccgggagaaccatagttcttcattgcataaatgtcaaatgctgcaccatagggtgactgaaccgttacctgggtcccgcaatatccggataccccgatctcatgcattgctgcagagccctgccagagccggtatgactttggaaagtcggtcgtatatgcacttgcagatgatacaatcagggcacaggcgatgagtatcaatagggctgctccggtataccaaatttttttcataataacacactcctcaaggtagttaccttgctttgttttctactagcgtgcaggatatgataatccttttgagttgagagatgttccgataattccggaacaaaaaaaagaattccggaagttaatccagctctatcattctgaaattacaatctctgctgaaggtgctgatacttctgaacctgaaccagtgtcatctgatgctgcagaggcggtagacatggttgcatccattcccgcagatgccacaatgatgggtgttgagccactgcacttgtagctgttcatcttgaggttataggttccactgccgctgcgggcatagaccatcacatagtaggttgagccactggagggtggagcgaccgatacataggcgttcgggccataggagtagtacctggtattacagtatgagttctttggattgcagtccttgaagacatacaggtcaaaggtgctgcctccataggagctgctctcaacagactgtcctgcagatgccacaataatcggggtgctgccaccacctgaagaggtcatggaccactcgatcttggatcttccgtcagtcgggatgtaatatccatacactgctgcctgaccctggtttaagaatcctgttctggtatctgacttatagatcccacagggggtcgggtaaggagtcggatacggggtcggatatggacagtttgatgtaacccgcagggaatacgaaccactgccagagtagccatacacaaccaggcaccaggttccagcctcaagggtcatggttgcagtcccgctgtaaccgtatgcaaccttgtcatagttatacaggattgaacttggtgaggggcaggatccatatccccacttcttctttgcatagagatcaaaccgggcaccatagctggagaccacggttgccgttcccgggcagtttaaggtgacttcgtatacctgtgacgtctggccctgccagagtgaggcctgctgttcactcagaacactcatttcttccgctgaggctggtactgccaccagagcacatatgataagcatcagacaggtgatgccaattttccagaaggttctcatcattccactcctcaaggcgtattgccttgtgatgaaacatactctcatatgtgaccttataaggcttgttgtcaggaaatatccggagtacagtgttttttacaaaaaggaaaatgccctatgaatgcttccattaccggcgccagagacatgaattctgataatcggaaaaaagaggttaccgggagatgacatgctcaccggtgtagagtgagaccacgccaccgattataataaccgctggaggcttgacgttacgttcctgcgcacgttccgcgattgtttcaagggtcccaatggtctcacgctgatctggtctgagcccgcgctcaatcacggcaactggcgttgcagcgtccataccgtgattcacgagaaattttgctatcttcccaaggtttttcacacccatcaggatgacgatggtgccccgtgatctggcaagccactcccagtcgattgcagactcttcttttgtcggatcctcattgccggtcaggatggttacctgtgatgcatatttccggtgcgttacggggattccaaccgatgcaggaacggcgatggcacttgtcacgccgggaacaacctccactgaaatgttatgcgcccttaaggtctccagttcctcaccgccccgtccgaacaggaacggatctcctccttttaatctgacaacattccggccctgctctgcgtaggagaccataagctgctcaatctcatcctgctcacgggtgtggtgatccccgtacttgccgacatctatcttctcagcatgggccggaagacttgccagaatctcttcaccggggagctggtcatagaggatgacctctgccatgtccagaacttcccgtgcccgctttgtcataaggctcagtccacccggacctgatcccaccagatatactgtaccttttttatccatgtgtaattcccagccgctcgtatgcttccctgatcagatctcctgccctttccctgacttcaagaccaaaccggtccgcatcgtcaatatctgataccagtcgttcaagcctgaagtggcggtcaccttcaagagagagaacttctgcaatcatcagacggtccttgcaatagatcccgagcggcgtgaagcatccgcccccgatcatctccatgacccgccgttcaagcagggtgtccatcctggttttggggtcatcgatcttcgatatgatatcggtaacatccgggtcggtccgtgatactaccgcaatggtcccctggtttggagaggggacatgtacacggggatccaattggtatccgtccagtgtcatggagagccgttcaagaccggcctttgcaagcatgatggcatcatactcaccactctgtaatttggagagccgggtgtttacattcccccggagtggtctgatatcagcccagggcagattgcgacgacactgggcggtccgccgggtgcttgatgtgccaagtgttgtgatctcatccagctcatggtcagtgacaatataatcacatggagagtcccgggcaagaatggcggaggttaccagaccgtatggccgctctgcagggatgtccttcatcgagtgaacggccagatcgattttattctgcacgagtgcatcatcaagtgcccggacaaatactccctgcccgccgatctcatgcagggggactccggtctgttcgtccccggcggtagagatgaataccagctccgtatccaccccgagatcttcaagcatcgtgcagaccttaaccgcctgggctttggcaagttctgatgccctggttcctacgcggagaggcatgatgcatacgccgaagagaggtattcaacatccgaatcagaatgagcagctgacaggaaattagtctcaaattgtgacgggggtaaaaagatccccttttccagcatcttctcccagaatgcccggaattttgtcgtgtctgattcttttgcctgagcataattttcaggaaccgatgaacggaagaaaaacttgaacatggacccaagtttcacaaacgagcctcctttcccctgacaggcttccccgatcaccgtcgtcgccgtatcgaggagcgtatacatcccctttcgtgcatgaatctcccgaagtgctgcaacacctgctgcaagactgagcgggtttccggagaaggttcctgcctggtacaccggcccggcgggcgcgataagttccatgatctttcttttcccgccaaatgctgatagagggagtcctccgcctatgatcttacccagggtggtgatatccggcgttaccccgaagagcttttgtgctccgccaatcccaacccggtatccggtgatgacctcgtcaaagatgagcaggatatcatgttcagcggtgatcttgcggacctcctgaaggtaccctggctttgggaggaccgggccgatatttcccatcacgggttccagaatcatggctgcgatctcgtcaccacttttatccaccagagagatcagtgactcggtgtcattgtacggaacctgcctcgtgtgccgcacgatatctgacaaaacccctgcagaatcaggctgaccaagggtggtacacccggaccctgcctgcacaaggaccccgtcatgagccccgtgaaatccgccctcggtcttgatgatgtcactctttccggtatacccccgtgcaagcctgatagctgccatggtcgcttccgaaccggtagtaacaaacctgaccatctctatggatggatgatcagctatcagtatctgtgccagatctatctctgccggagtcggggtgccatacagccagccatcatccagtgcagaagagattgcatcgccaaccggtttacaggcatgacccagaatgagcggtccgtatgccccacaacagtcgatcagttcagtcccgtctacagtatatatgcgggagccggatccccgtaccgtgtaaaaggggtatggctgtattgcccggaccggacttgaaacaccaccaggcatcagatccctggcaatggtataatattccctgctcttttcactcatgttcgcttagccacctgcatacatcttcagcaaaataggtaatgataaggtcagcacccgcccgcttgagcgagaccaggctttccatgacgacccgtcgttcatcaagccagcccatctctgtcgcagcccggatcatggagtactctcctgatacctggtacgctgcaaccggcagaccaagttgtttaatgtcagtgatgacatctccaaaccatccggccggtttgaccatcaggatgtcagccccttctgctgcatcctgctcagactcccggtacgcttcccggcggtttgagaccggggcctggtacccggtccgatccccgaacgaaaagcctgagcccgccgcttcacggaacggaccataaagggcagaggcaaacttcgaggagtatgacatgatgaggacttcctgatgtccataatcatcaagagcctcccggatggcagcaaccatgccgtccagcatacaggagggagcaacaatatctgcacccgcttctgcctgtgagactgctatccgctgcatcatctcaagcgatgcatcattcagcaaatttggcccgtcacagcattcacccacatagccgcaatgcccatggtcagtatattcacaggcacacaggtcggtgatgatgaccatgtccggacaggtctttttcatcgcccggatcacctgctgaatgaccccctccggtgcatatgctcctgaggcttcagcatccttgacagacgggataccaaacaggagaacggcacggataccggcagtcctcatccgggttacgacctctgcagccatagaaaccggccagcggttttgtccgggcattgccagtatcggaaccggttctgctatgttctcatcaaaaaagagcggtgcaatcaggtcatctttcccaatatgggtctctgcaagcagcgggataatcttttgtctgcgaagtcttctcaatcgtacgtgcgggaacatatgttctctcctctggtaatggcaccaaccaggtcctctgcaatcttcatctctccccgttcagcacaggtccggatggtaagggtaacgtcagtgagcagttttctggtcagcacccgggtcagatcatcggtcacatcgcggacccggtcatcacatcctgacaacctgctgagagcccgatcccgctccctgatccgtatctgctcagcccagctgtgcaacgttgccaggagttcatctgctgccttccggttaaagagtcggataaactgaaccagttcctggtcaagaaattcccgaaccttctctgcagcttcctttctgaactgtgcggtatcatcattgacttttcggaggtcatctatcgtgtatagacagacgccaggtatcttgccgacatcctcttcaacatcccgcggctgggcaatatcaacgatgatgagcggtcgccgggaatgatcaagcggccatgatctccctttcaatgcctccatcacttcctgtactttaatcaccggatggggagcagcggtgcaacagatgatgacatcagacatggtcagataccggtacaggtctgccatcggaacggcggtcccgtgaaccttctcagcaagacattgggcccggtcaaatgtccggttggcaacataaattgcagacagctgtttcgccgcaagtgcctgggtgaccagaacccccatctcacctgtccccaggacaaggatgtgccggccggccagagatccgagctgctcttctgcaaggagaaccgccgcagacccgatcgatactgcaccccggttaatgccactgattctccgggcctcggacccggcatggattgccttgttgatacagagggtgatcagaggatctgcaaccgacatcgattcagacaggctcagggattttctgagctgtcccaggatctggtcttcaccgatgaccatcgagtcaagacctgctgcaaggtcgagaagatgggataaggcatctgcatccttccacatctgccatccggcccgtccctcgctctccagaaaggtgccaaggagatctgcattcccatgtaccatgatctcaatccggttacaggtctgtagcaggataacccccttaaaccagtcaccggcacgggtaaggaaagcctcttcatcaggaaaccggaccgattccatatctgccaccgatgcagtatgatgggatattcctgcaatggtgaatggtgaaaagagcgcatgtgtcatagtgcaaatctcctctgcacatattcccgggctgcattcatcccattcgtgagggcttttcttgtttcagggtcacgaagaacagtatacaggacggtatcatatgattcggtaccggcccgatccccccggtagatgtcccggatccattcgcccaggaggatgagatcgtcaagatcaggaaacgttttctcgatttcttcacggaccagtcgtgatacagccgggaccgagccggaggtgctgactgcgatgacataccggttccctgatatctttgcgggaaggacgacatcaccccgtttccctgccgctacattgcaccagatatgttcacgggcgcaggcgctttcaatcagctcgtttaattcaggatctgatgtggcagcgatgaccagcgacgcatcgtgtatcatatttcgcaggatttcaaggtctccagtcagattgcagacctcagttctgaccgggatctcctgaaactccgggtgaaaagaacgactgtatacgaggacgtctgcttcatatgcgaagtaccgtgcctttctggctccgataacccctcccccgaaaatgattactttcttgccggtaaagtcaatcatcagggggatcattcgtatgaggtttgcaggtagaaaatatcaatctgtccaattattcctgacattgttcatacgaacagatccaggaaagatttcggcagatttattacctcacagagctgacgatgtagagcaactgcgttgatagtgtagtggttatcactaggcgttgccaacgcctaaacccgggttcgaatcccggtcagcgcactcaattcgtataccgtccccttttttgcatgtttgtttctatgttgttttttatagaaggcgtttttttgtaattagggcttgttttcagggtatttttttattgatacgagttttgattatttgagagagagatattgtagactctctttaggcgtgtaccggggtgcttctagccttgtgtttataaatgatctcgatttttcttgtctttgggtcgtcggatttacggggcggtatataaactcctcccttcacgaggtgggcggatgtggtcttggacagggagttgtaaggggagggatcagggtttggatagcgagaggatatgaggggggagagtttttatgggttttcgggaaaatttgaggggttttcgatgtcggagttgctagggggtgcgagggagccgcgaagcggcgaccgagtaggatggaggagaaggaggagagacagggttctgtttgagataattagttgaaggtgtggtggaatcgctattagatcctccttgaattgttcgggattttttgtgggagagaatatgtggaaagggtgagaataaacagacccgatgattcctgacggtgtgcctggtgaatcgcatatgaggggagggtcctgggctgaccgggagaggcatctgatgattaccggctatgtagatgatagccaggaacagaatgataaagttccgaatcgtgatctggctccatagacattgagagggttttatattaggagaaagaatgattgtaattgtcagagtacaaaatccaaatgccaaattctgggatgaaatttatgcatatgagttgaagaaatgaagtgcattcaatgtaatgaaggtgtaacggttgatagttctaccatcgtcgcatttgaaaagaatggggcggctttccttttcaggcatgtgccggcaatgatctgtccggtatgtggtgaagaatatttatcagaagagatacaggacaggatatctgaaatcaaaaaccggtgcctggaacccggtctttcggttcaggtgtacgattttcggtcgtgatcttattatgtaaaatattcaataaatttaataatatattccaattataataacacaatggcatctaaaccttttctcaaaatagatgaccttcatcaattttgttgtcaaaactcaaattgtccggactatggaaaacgaggaattggaaatctctcggtaagtggaacctctggaggtcaaggaaaccgaatgttgagatgtaagacttgtggatatcggttctccgaaactagaggcactgcgcttcacaactcgaaaattgagcatgaaaaagctgtttcggtcatggaacatttatctgatggatgtggtatacggaagaccagtaggtttacaggtgtgagtttagggacggtcgctagacttttaaaaaaggcagggccccatgctcaattaatccatgatgaattggtttctttttccccctcagacaaatgaggttcaattcgatgaaaagtggagttttgtcggtaaaaaagataagaattgtgatcctttcgacccaaatgatgaaaaatatggagataactgggatcacatggcttttgatccagaacatcggttagtcatttcagtcatccccggaaaacgaactgcagagaacatccacaaactcattgaagacttcattaaaagaaccagggggaaattaatgagattgataacgacggacaagtatatgccatacaaagaggccattcgtatcggatacggcagactggttaatcctgaaagaactggtaaacgtggacgaccaaagaagccgtattgggaagtcccttctggattgatttatgcgattgttaaaaaaactctttccagaggaagaatatccaaggtggagactgaacttgtctttggaacagaggaagggctaaaaagagcattaaaacgctcaaaagttagcaaaaaggtaaatacttcatttatcgaaaggcagaatggaaccgacaggaatcggaattctcgaaaaattcggaaatcactttcattttctaaagaaccagaggaacacgaagctatgacgttcttttgcttatatagttgcaatttttgttggccaattcgaactcttcaaattcaagatgttcaagggggtcattcaataaaacgaacacctgcaatggcggcaggtttaacagatcacgtatggactatcgaagagtggattcgatttcccgccgtgcagttatgttagatcaccaccgaataattgaaattatcgtattgaccacagattgcatgataggatcggtaacatgccccagagtgtattgaatcatcgatacatcagcggtaaaaagtttatctggcctgatataactcatctcttttagactcccagatatcaagtctaacggatggagggggatactgcttgtatctgagtgatattttgaagtgatttgacacaggatcagatcatccccggatacaggagctatcactaatgcaggtcgtcgtttcacagaacttaaatctgagaatggaaaggggatgacgacaatgtctccttttacaaatagtcccacgcctcatcctcttcagatgtgagccagtcacgggcaaggactcgttcactcatacaggcggtttcacagatgtggaatgtatctgaagaactttccctttgaggtttatcaggcggaatatcctcaatgatgagatgatacttctttccagcctgaagatttactggctgatccggcactagggcttttccatcatataccgctgaaacggaagattcgataatcatgatagtaccttttgcttatacgttgataaaggtttaatcgtacctaaaagaatataaaaatcgtgaaatggtaaagaaatattcaataaattttaatttttcccatctcccaggtaaaatagggagtaaatactcaactttaagaagttaaacaagttatttttgttttatgaaaggagtggagttattcatgaatgatccggtcattgaggtattccggtcagaaatactcccaaaaattatcgagttttttcagcctgatgatactatcctgttgattcacgggtgcatggaactgtccatgatgaatcagatcttgatgtgattctggtttcagagactttcagagatacacccaggcatgagcgatttcctcttgtcagaaaaaggattcaaacagaactatgaaacgaaggaggaaaaatagggttatacttggggcgttgtcaccagccaggtggtactgttcgaataactgtaccgctcaatcttatactcgggacaaatctcggacaataaggccataatggtccctacctcttttgaagataatccggtatccttggcaatatactttgacttaaagaagtttgatcctggcttcaattggcttttcagataatctattaagcagatctgattttcattgtattttgtggtaaatttactttgtaaaagcatgtctatctccataagtactgatttttgctgaatgaattgtaggaggaaatccggtcttttatagaccgggtgaagttcgttctggtcaggagaagagaatcggaggacatgaaactctctcctgaccgggggagtttccttttcgggatgagttggatccaacagttgtaggaggacatgttgaacactactcaccgacagagatcctgtcagacatccaggagttacttcctggattttttgcaggtctctgtgtgacatacaaatgttgttcgaaacaggttaaaagacaaatagacaaaactgatggaaaatagtctgaaataattttagagtgcattgatactttttttattgaataacttctgcagatcattatgagcggaaaatgagaggtcaattatcggttgcacctggttctgagaacaactcaggttttggaaaaaatcagataggactgaataaaaaattgaaatctacatggtttcaggagttgcaaccagtatcaagatctctaataagaagaaaatttatgaggagttgcttgggggatgacgtgtattgatggtatctctcgcgggaggagggagcggtgttatccctccacttgtgccacccttactttactcaggtgccgtgaagctgtctgcctcgttacaccaaagctgcgggcaatgtcagcagctgttacatccggatgcagctcaatgaaactccggatccgttcactccgatccccgttgtcactcagctgcggtgaagctgtcacacccgctgtcaggtctgaccggatgatgttcatgagcaattcaacggaaatgcagagcgaaaatggtgggatagcatgagaagcctgatgcaaatacccacccggagagtaagcgatattaaaccaaggtagcgatcccggtaaaggtgatgaggtctccccacctgaacgccgaggatgacccctggactatttccccggaggaccaaagggcccggagatgaggggggcatcaatacagatcggccagctacccgagcgggaataggatcaaatcggcgagggctgcttatgaacggaggctctcaaaggagaggacgtaggagcagagggcgacgacaagggtgagaactccggttcaaggtatggaatattcaatattttttctggtaagcggggagataactcagtattcttcaacattagtatttcgggatgtcaaaaaaagggtgtttttttatgacttagcggactattgataaatattatatggctgaagtcacatcggagaataacgaagttctatttctactccaaaaaatcgagagcatcattgatacccggctcattggagaggttgaacctcttgatgatgaaatcgaattaattggtgaatatcagaaaagaaaaagcgaaggtactctagagcttcatgagatatagaatactccttgatacacatgccttgcgggattttcaagatattcccgaaccatatcatacatcaataaaggaaaagtttgagcgattaaaagaaggatttctcccagatttagatattcgcaagttaaagggatttaaaaatacgtaccgattgagagtcggtgattatcggataatttttgaattaaatccagattatgagatcatcgtgataggtattagacctcggaaaacagcttatcgttgataagtctctgatgatgttacatttcataaaataattaacattgaattttaatttttttttgagagagttaagggattagttctttgaatgattgtcaacgtatccccctcactttacttagaactttcgaagctgattgcctcattacaccaaagctgcaggctatatcagcagccgctctccggatgcagctcaatgtaactccgaatccgttcactcctatccgcgttgtcactgagctgcggtaaagctgtcacacccgttgtcgcctcatttgtcaggtctgaccgaatgagattcatcgttacttccacactaatgcacagcgaaaagggtgggatagcatgggaaacctgacacaaaaccccatcaggagagtggacggtattaaacctaactttgccactttgacttcatacagtcaatgagatcgttcactatcatgatcaaaatttttcagaatttcatcgggaaatgatatttaatcaacttcattattgcaaattatgtgattttgtgagaggacacaacatatatgtaaatatctcataaatctacatacacatatgggcactgttaccatatccctttcagatgaggtcgaaaaacggttccgggaagtcattactcgtgaatgtggaacgaataaaggagcaataagcaatgcaattactgaagcaattgagctttggataaatgaaaccagacaacgctcacttgctgaagctggaagaaagattctagcgaaagaacatgatataggtgaatggcattattcacatagaaaggagctttatgatcgaacctgatgcgttaattgattccaatatttttgtttacgcatgggtttcccaggagaaagaaaaacatgatattgctctccgtttatttgaaaaggtttgaagcagggaaattatctatgcggtttcagtccaaaacttagcagaattctcttcagttcttcttactaaaggcgaaagaaaggaagaacctgatgagatatctgcatttattcagatcattcatgaattttctcattggaaagttctgacatatgattcggcaatcataatccgtgccctgaatatacataaagaatatgggcttcatttttgggactcacttctcgttgccaccatggaaaagaatgaaatccgacggattattacagaggatatccatcttaaaaaaataccatggattgaagtaataaaccctttcaatgagatttaccatgaagaaaaaatcgtaagttataatacacgaactcatatctgacaccttcccattttataatcatagttccatttgtaaactcctgtaaccagaatcacccaatatcaccattttcaggtagagaaaaccaaattaccctctcacaaaatcaggatggaaaaaactcacacccctgcctgaacattccgtaaattaaaaaccagaaaaaaataaatttttattaatacgcacactcaacttttccttcactaactttacctttacaacaggactcggtcttcggattgtaacaggtatcgccacacttggtgtatcccttcccatcatacacaacaccaagacagcagctctggttgttcttattgtaacaggtatcgccacacttctgccatccggtccccgggtaaatctggttattacaacaggtttcattggtcagatcatagcacttcccgccacagattccccacaggagtccgtctttcggttctccctggcagcaggactgggtgatcggattatagaatgaatcaccacaggtcgggagacaccgtgtcccgttcacaggctttccattacagcagacctgtttttcaatattatagcaggcgtccttacagaccccccaatggagcccgtcatatacctgaccctggcagcaggactgcttacttgggtcataacagctgtcaccgcaggggatacaactctgatttgcagcgatgaccgaaacggataaggcaattgtgacaaaaaggaccgctccggcgatccatatatggaatcgattcatgcagcaatgtacatctccaccagctcaagaagtttctttatcagtcatgtgatcccagaatatttttcatcatatcagaacctgacatcctcattcataccccatgacgtacataatacactgtatctatgcctgaagaaccaacacagagagttgctgttctggtaatgggctgtccgaaggtcccggtacagaccagtcttgttctttatctttcaaaccggatgaaaaaggcagggatcagaaccatcattgccggaactccttcagccaggcaactgatacgggttgcagacccggacggccattacaccatggagatgaaagacctggatgcaaccatagcagctctggcaaaaggcgatctcaccgtcacagagagttatgtctttgttcataatgacgcaggggtaagctatgccgcgaccatgcagtccctgacgaaccaacccgtgatggctatcatatttggtgaggaagcagagcagatcgctcaggaaattacctttccatgcaccgtcattgccgagcctgcaacacacaacccgatgtcactaaaaaacagacttgaggaggctgccccatgggatgcttagaatctctgccatatgaagtactgatgtcgaaaatttcattcaaggaagccagggaatttctctccaggtaccctgagaaatatgatgtggcaccgggataccgtatgtttgatctcaatatcatcggagtcccaccgatcagggttgcagttgatggtgattcactcatcttcccctatacaaaaccatgccatggaacatttctcatcagggtcccgaatgcaaccgacgaaatcgcccggcttcggggacgtgcctaggaagagttcatgcgcccatatgtgatcgtcaatgtggccgtcagtgcagacgggaaactctccaccagggaacgcaggcaggtgaagatatcaggaaaagaggattttgaccgggtggatgagataaaagccggctgtgatgcgataatggtcgggattggaaccgttcttgccgatgatccttcactcaccatcaagtctgccgaccgtattgctgaacgggtcagaaatggaaaaccagagcacccggttcggatcgttgtcgacagccaggcacggacaccgccggatgcgaaaatcctgcacaaaggccctggccttcggatcattgccgtgtcactcgcagcaccagaggagaatatttctgccctgaaaaaccacgcagaaatcattcaggctggagaagtgaccgttgatttacccgttcttctcacgaaactagcagaaaaggggataaagcggctgatggtggaagggggagggacgctcatctggggaatgctgtccgcaggtctggttgatgaactgacaatgtttgtcgggaatatcattattggcggaaaggatgccccaacccttgccgatgggaccggatatgtattagaatcagattttccggttcttgaacggatggacgtcatccccatggaagaaggggtattgatccactggaaagttagaaaatagtggagaaaatacatgataagaggctacaccgcattcattacacaggcgaatggcaatgctgtgcaaatgcgataccttataatatctgagatgtgacgttcacgaggttgtagtgtctgatcaaacaatctttatcgtcgaagataacccggttattgcagatctcatatcatggcgactgactgaaatgggataccatgtcgcgggaactgccgaagatagtacgcaggctctcatcaggatcggtgagattcatcccgctcttgtcctgatggatatcaatcttcccggtgagatggatggaattgatgctgcatccgagatcatagagaaattcaaaatccccattgtatatatcagctccatacttgatgcagacattatggaacgggcaaaaaaaacaaaacccagagggtatattgtaaaaccctttaccgataaccagcttcgtgccaccatcgagatggcattacagggatgaaggtcataccagcccgataaaattccgaagtattgcaaggccgcattccccgcttttttccggatgaaattgaactcccactgcggtcccgtttcgtattgatgaagcaaatgtattgatataatcagttgatgtaatgcaatattcagccggagtatctgcccagtaggaatggacaaaatatacatacgaatgatttggaataccctcaaagagaggatcatcctgcttttcaatagttatctggttccatcccatgtgggggatcttatacccgggcatgtcagaaaaacgccgtactgtgccggggataaggccaagaccctgatgtaatccgtgctcttcagagaactccatcatcatctgcataccaaggcatatcccaaggatcggaacatggccttcggattcaattaaagcctgcgacaggtctgcaagctgggtcatcccttcatgaaaggcaccgacgccggggaggatgatcccatctgcggaacgaatctcctcaaggtcatgcgagataagaacctctgctccggccttttgaaccgccttgctgacactgcgcatatttccaagaccataatcgacgataacaatggaattcatattgccttatctccctgagttctccattgcccactctcaaaccaggattgtgatatacccttcctattcatccacaatgatactgcctgctcccattcctcccagagttcgggatgagtagcctgaatcttctccagtactccaaggtcgctggcagggcacatataacaccccatccggtcaaccccatgccggtacatctcattaaaaggagccttctcccggaagatatacagccatacatggagagccgtccacgtatgtatcggggctagacatatctgattattcacataggagttcctccagaccctggggtttttcatccgtgaaaaggactcatacttgcgttgaccaatgaaagatactatctcaccatcctcaccataggttttgacgatgtactggcgcaggggctccagtttggaggttcggcaacaccaccggttatccctggacggaggaccggagacttcaaagtcccgccagaactcattgatagattcgatcctaacgcactcaagcccatatcggtcctgcacatcgcagacattctcttcggttgatggaaactcaaggccggtatcgatatagagaattggcatcttgcgataggtgttcatcacgacaagtaatgttgcaagactgtctttcccacccgaatatgagacagacatagggagatgctcatacgggccgatgctgtccgcgatgaattttccagatgctgcttcaacttttttgagcacgtcagcatttgcctgtacgacatcatcccaggttgcctcaccgggtgtataaacggaggggatattttttcttgtcttcaccacctgtccccgctccatccgatttgcttcttcagcatccacccgtgccctgccaacaccggcacagataccagacggggtcattataaagacctcatccccctctctgatcgaggagtcacaggagataagaccgggagccagcagacttctgccttccctgatagaagaaagcgccccttcatcaataaccataaaccgcttttttggttgagcaatcaacgccgcatcaggacggggaagagcctcccagcgacgttctccgggaagatatcggatagcccctactatcgctccacctacgattatctcttccatccggtcatgatccggaactttattcataagtgcgatctggccttccggaatgatcgacattccaaactgttcttcatatatcgaatttacaaaggcaatatcttcgggaaatgcgggtcgtgcatcaccaggaggagttaccgggactgctctggtagctgccccgcatgcacaatgctcagcaagaaccggcgtatgacacgaatcacaccagtgaaggagaattctgccgtggtataatccacccatatctccccaattgtatgatctaaccctacatactggtttgtacggaccattccttcaaacatcagaaaatgccttttttcaataaaataaaaaagctgatcgaataaaaaatattatatgatgcggataaccacctcagttgatcacgatctatcatgacatatcgagagggtttggcatgggtatgccattatgatgaccgggtacaggtgatacaatgatcccgtttatcgttactgcctttgtggcttttctgttttatctggtgttggtttttggttccggctctgttctcttctggtcatgggaggaaattattgcaggtgtcatcatcggacttgtgaccggtgttatcgctcggaagatcttctgcaggagtgagaattaccggatgttacatccggtacggctcatcagcatcctgatatacatctgtggtcccttccttgtggaactgaccaaggcaaatctggatgttgcataccgggttattaccggaaatgtcaggccagggattatcaggctccattcagggatgaaatctgatctggcaataacgatgcttgcccattctattacactcacaccaggaacgctaagtgttgatgtcgatgaaaagaaccatgatctcttcattcatattattcatctgaacgaaggtgatgagaaaaaagaggcatttgaggcgagagagatcttttcatacatgaatattccagcctggatccggaggattgctgaatgacagatatctttatgattgctgctctggttacggcagtgatcatctttggtgccctggtaagactgatccttggcccgacaaacccggaccgggtggttgcggtggatactattaacacgctcacggtggcggttatgattctcctcggagtggtgtatcagcagtacatcttcatcgatgttgccatcgtctacgccttactctcctttgtctccaccctctacatcgcaaaacatatcggtggtgagctctgatggttgcagatacaattatttttatctttctgatcatcggcctcttattcaatgccctgggagtattagggcttcttaggttcccggatgtgtacacacggcttcatgcttccacaaaagcgacaacctttggaagtatcttcctctgccttggggtggtcgtgtttgcaatatcccaatatctgggaaccagcgattcccagtacctcatggtcatcacccataccatcattgcagtcttcgctcttgcaataacgaacgccgcaggatctcatgcaatcgcccgagcagcacaccggagcggacagaaaccagacccggctattgttgataaactgacggaggcaggcctgtgatagaaattattcacattttgatcttaattgggatcctcattactgcagcactgatagtttggcagaaaaatctcgttgccgccgcagtcacctttgcagccttcagttttctcctctcgattgaattttatatcctccaggctcctgatgtggccattgccgaggcagcggttggagccggaatctctactgcaatatatctcattgctatcagggccacccatgaccaggaggtgacatgatgagaaccaaggtggcatggtttactcttgtggttctggcaggcagtctcctgtttgctgcattatcaatacccttcggagaccctgcgatctcagacatggatgattactttatcgcccatggtcaggaacagaccggagcaaataacattgtaacatctattgtgttcgatttccgtgcctttgatacccttggtgaggcatgtgtcctgtttaccgcagtctttggagtctcggtcctttttagacttcggaaaaaaggagaggattacgaatatgagtaatagtctgagtaaaatcatccggacaacggcggatgtgatgttcttatttatcacggtgtttggtttttacatcgtgcttcacggtcatttaacaccaggcggaggattccagggtggtgctgttatcgcaaccggatttatcctgttgatagtagcctataaactggatgactttctggggtggttccagaagagaacatttcagaactgtgagatgtcgggtcttgtcctctttatcgggactgctctcgccgctataccactcgggtatctctttttcatgaacttcttaaacggaaccggaggtctctttggccagacagtaaactttgggataaatcccggttttctgaataccgcggggacgattcccatcatgaatgtagccgttgggattgaagtactcgggggtctcagcatcatcattttgtatatgacaagcggaattcgatcacatgaggagggagaatgatagataatcttccatttctggtcgttgcaataaccatcctgctcggcctgtatactctccttctgaaaaaggacctcattaaaattatcatgggaatatcactcattgaatcaggagtaaacctcttccttatcgctctcgggtaccggtgggacagtattgcacccatctttaccggtgcaccgtcccttgccatggtcatgcccacggtccaggccctgacactgacgagcattgtcatcggtgttgcaacccttgccctgctgctctccatggtgatgataatttaccggtattatcggacaaccgacgtccgtgaagtctcaaaactccaggggtagaacatggatatactacttgataatctgccaggacttctcatcgcaatccctctgctgggagcatttttaaccccgtttctttcaagagcaggcgattctgtccgaaatgcctggatactgctcattgccgctctttcatcgctctgtggccttctggttgcatcacgggttttagagagcgggacgattgtgtatgcattcggagttgatgcgatatctcatgttatcccgccggattccggaggcatccccatcaggatcatctttacgatagacccgatgaacgccttcatgctcataatcgccgcaattgtaagcttttgtatcaccctctactccctctccagcatggagaagttatcagggaaggacgggttctttaccctcctcctgcttctcattgccggtgtatacggaatgataacaaccggcgacctcttcaacttctttgtcttccttgagatcagttcccttgccggtgctgctcttgttgcataccggatagataagggagttgccgctgaagccggactgaaatatgcagcactctcaacccttgggggcatgctctttctggtgggggtcggcctactctttgcccagtataactccctgaatatggcggttattgcagaccggatgcagatgaccggacttgatataatcgcatttgtcctgttctttactgcccttgccatgaagtgtggagcggttccgatgcacttctggacaccggacagttatgcaatggcaccgtccgcaatcacggcattcctggtcgtctcatcacaggcaagcctctatgctctcttcagagtctgtttcaccctctacggtggtcagataaaccctctgaccgtcggatgggtcatcatcatccttggagtgctctcgatgttcgtcggtgtcacgatggcaatcccgcaaaaggatgtaaaaaggctgatggcataccacgccgtctcccagaccggatacatgctgcttggtgtcggggtagggcttgctgctctttccagcacctgcctttcccagagtgtcggtatgatggcactgaaaggagggctctttcatatcatgaatcatgccctgtacaaaggtctcctgttcctgaccgccggggtcatcatgtaccggtgtggaacacgaaacctcaaccaactcggcgggcttggccacaacatgaaatggaccatgatctttttcatgatcggagcgctggcaatcgcggggattcccccattcaacggatttgcatccaaactgctcatctatgaatcgacattcctttttaaccccctccttgccgtcatcgcgatggtcgtcagtatcctgaccctggcttcgttcgtcaaggtcttccattccatgttcatgggaccaaaactccctgaataccaggatgttgaggaagcaccaaaaccaatgctcattgccatgggaatactggctattctggtcatcctctttgggatcttcccccagcaggttgtcgacactctggttgccccggcagcatccgcccttgtggattataacggatacattgcctcagttctcggaggtgtataaatgatcgaatcattcacgctttccaccggttttggtgcttggaatgccgtattctgggtgattgcctttgttattgccttcatcatcggctggataatctggtcacggggtgagaagacctatgacaccagccctggagcaacggctccattcctctcgggaaatgcagaacctgaaaaagaggcggtacatatacgggccgggaacctgtactggggatataccgatgccctggcaggatactataaatttgttaaacctttccataccggtaatctttcagattacttcctggcatacctgtttgttactgctcttgtcctcatcgtggtggtgatcctgaaatgaaactctctccatcatttaaccggtcgctctgggtatttcatgtgaattcagggtcctgtaacggatgtgatatcgagatcgtcgcagcactctgcccccggtatgaccctgaacggtttggaatcaaacttgtcggatcaccacggcatgcagatgttctgcttgtcaccggtccggtcacccaccagatgagagaccgggtaaaacgggtatatgagcagatggctgctccgaaggtggtcatgtgtgtgggaacctgtggtcagtccggaggagtgttttatgactcctataatcttgacggaccaatcgaccaggtgattccggtggatgtgtatgttccaggctgtgcaccccggcccgaagcaataatatatggtgtggtgcaggcgattgcaaaacttgaacgactagaaaaggaggtgagttcatgagagcaaccatgacaccacaggaactggcagatcggtttatccggaaattcggcagccgggtgagtaatatccaggtaaaggagcggcgtgaaggagtaaaaaaactcccccaaaagaccgtgtggatgacggtttcccgtgaggacctcaatgatgcggttgcagagctcatctccatagattatccgcatctcggggttatcgcagcatcagataatggtgacatgattgaccttctctaccatcttcaggtcttctttggtggaaaacacgaggagatctgtgtggtgttcaccgtccaggtcccaaaatcagatccccatgtgccaacaatatcaggcctcattcccggtgctgtctattcagagcgtgagaagcaggatatgatcggtgtgacggtagatggcattccggactcacggcgtatctttctgcctgacgacttccctgaggagatatacccctggagaaaggatgagaagggcattcccccgtccatggtaaaggaactctggaaggttgatcgccccaccgaccggccggtccccccggtagcagaacctgaaccggttgagaagaaggaaccagaacctgccaaagaggctccatcaggaggtgcagcagaatgagtcagaaaaaagcaccctatgaacttcccatcgggcctatacacccggcattaaaagaaccaataaatttcacctttcagatgaatggggaggttattgaaaaggttgactttgcacccggacgggcacaccgggggattgaatggatggggatgcggagaaacccggttcaaatcctgcatctctgtgaccggatatgcggtatttgtggagttcaccatgcacttgtctttgcacaggcggttgagcagatcgcagatattgaggttcctgaccgggcatattatgtccggaccattattgcagaatttgagcggatacagtctcacatcctctgggcaggagtcgcagcccatgaactcggatttgataccctcttctaccttgcctggcagatacgggaagagtcagtcgatgtgattgagtatataaccgggaaccgggtcaattacggcatcatgatgcttggcggaacccgccgggacattaccgcagatatgttcccccgtctggaacaggcactccagtactatgaaggactccttgaaaagatggtcaatctcttcctcaacgacaagaccattgccatgcggtgcaaagataccggaatcctgacaaaacgccgggcattggagcttgcaaccgtgggacccacctcacgggcatcaggacttgccatggatgtcaggattgattctccctatgcagcatatggcgaccttgattttgacatcgtgcttcctgatgtgtataacagcgaaggtaacggggatgtctatgaccggatcatcgtccgtatctttgagataaaacagtcgattgacatcatcagacaatgcatgaaacagatgcctgaaggtccagttcttgctgaagagaagtatgcaaagttgctcatgaatctgaagaaggcatccggcgaggcatttgccagggttgaagctccccgtggtgaagatatgcactatgtcaggatgaatggaaagcaggaagctcccgagatgtggaaggtcaaggcatccacctactcaaaccagatggcatgggtggagatacttcagggagaacagattgctgacatcccgatcattgttgcatccatcgatccctgcatgtcatgcaccgaccgggtggctgttgtcgggcaggatgggaatgccggtatcatgacaaaagagcatctccaccgattgtctgttgagaagacacggaggcttcagtcatgatcggagaacttctcgccacaggtgtgggcgctgtccttatcaccctttttggtatcatcgccggtctgttcctcatgggtattgatcgtatctgtgctgcacggatgcagatgcggcagggacctcccctgacccagcccttcaccgatatcagaaaactcctctgcaaagattcagtcgtgcccgcaaatgcaatcccgtcactttttaatgcagctcccatcgttgcatttgcatcagcggtgacggtgctcttttaccttcccctgggcagcattctcccggtcgggacacccctgccgataattggagagtatggagatctcatcctgatcatgtatctgttgactgttcccgcccttgccatggttgccggtggatttgcatcaggatctccgtatgcaagtgttggtgcccagcgtgagatggtgaccatgatcgcctatgagttcccgcttgcgattgctattgtcgcaattgcctggagacttgccgttgcaggactggtcatgccattctctgtgaacacgatcgcagcacatcccatatggacggaagtcggacctgcggggatcattggctgtatcctcctgcttatcgtgcttgcatgggtcacccctgccgaactctcccggatcccctgtgatactcctgaagcagagactgaactctgcggtgggcttctggtcgaatactcgggacgaaaccttgcactcttttccctctccatggcggcaaaactggtggcgatggcaggacttgccgtactccttttcttcccgtggaacctctctccggttctcggattgtctggaatcatgggagccggggtagatttgcttttcttcctcctgaaggtgatagtggtgatgtttttctccgtatcactcgtccgggttgttatggcacggttcaggatcaataccgtggtatccctgtactggggatggctcacgaccatcggactcatcgggatgtttctcatcatccttgacgggagcttcctcttcggggggtgcttatcatgattaaactcccctcagttccgatggtgcttcgccagatcctgaaaaagccggcgaccaacttcttcccggcaaaaaatctccccccgacaatcaccggatttctggagtccgtcgctgcagaaaaggcaacaatacatccaccgattccaacaccagttaaataccgggggaagatcctctatgaccggaacacctgtatcgggtgtaaaatgtgtatcagggtttgtccggcaaatgcgattgagtttatacctgataccaagagaatcaggatctgggtaacccagtgtgtcttctgcagccagtgtaatgacatctgtccaaaagactgcctgcacatgtcttcagacttccttttagcgactgaagaccggtttaacgaagatatgattgtagaataatatgaggagatccgatatcaaccggataactcatgcatcatttttttcctggtttcagtaagggcaggaccgatagataccggatatctggatggatgcattagtctgaccacgtcagccggtatcgactgcaccgaagcaataacatactttctgatatcaggtagtgcacgttccggccggacaatggcgccaccatataaagccggggttagcagggggacagaaccaggagtatcaaatccggcagactctagttcgatacagtcaccggccatcataccctgagtatcaaatgagcggtatacctgcttgataccaggaagcgaggtcttgtcagtgtgatcagttaccttcatccgcatctcataggtgccggttgtgtgctctattgctgacattttatatacgccggcaatggcaggtgactcatgaccggtgacaagcctggtcccgaccccgtagatatcgatcggtgctccctgctcttttagtgcgtaaatgctatactcatcaagatctccagatgcgactatctttgtctcaaaaagccctgcctcatcaagcatcctccgtgcctcttttgagagagagagcagatcaccgctgtcaagtcggacacccgccagggtattcccctgttttttcatctcgtgacccacctttatagcatgaaccatcccgcttctgatcgtatcataggtatcgacgagcaggattgtggcgttaggaaaaacctctgcataccgtctgaatgattcaagttcagaaggatatgacatgacataggaatgggcatgggttcctttcaccgggatgccaaacatcttccccgcttccatattagatgtccccatgcatccaccgatgtatgcagcacgtgaagcagacagtgctccgtccggcccctgggctcttcttgccccaaattccatgaccgcgtcaaacccggcaatcatgcagatccgtgccgctttcgttgcgatgagcgaagaaaaattaatacagtttaatagagcggtctcgaccagctgacaggaacccaaggggccgcgtaccctgaacaccggcccgccaggaaaaacaaccgtcccttcatcgactgcatggactgaaccgtcaaatctccagtctgatagccaggcaagaaaggcgtcatcaaagatatgaagagaccggatatacgcaatatcttcctttgaaaaccgggcatcccgaagaaataagagcgcatcgtctattccggccgctataatgtattcaccctgaaatggacaggatctgaaaaaaagatcaaagcaagactgattatttatggtgcccgataaaaaccagacatacatcatggtcagttcatacaaatcggttaggattggagatttcagattactcatatattcatatacctttctggtatcaggtatgtcatctctcaataaaatagaccattagtctgattctgacgggatctgtgcagagaaacagaaaactgacagatcgaaatattgatgcgataagcacttgagatgatcagcttggtgatacaagatgcacctccccccactcatacctcccgcatctatcactccttatctatcctgttcaggagtgatcaactgcacaaatgcagagatacggactttggcacgcacattaaccagctctgaaactgatgacattgaacggaccagaaccctgtacacatgggtacgggattcaataactcattcagttgatgccggacacaaagatctgatgtggaatgcgaccgatgtcctgaccgccggacacggactttgttttgggaagtctcacctgtttgttgccttatgcagggcacttgggatccctgccggtctgtgttatcaacgggtgcgacgtgaggatgggagctgggtgctccatggtcttgctgcagtatacctcgaacaactggacaagtggatccgacttgatcccaggggtaataaaccgggagtatctgcagatttctcacttgacatggaaaaaattgcatatgaaccatcatatgacggggaatggctggatcagcatgtctatccggaaccctggcaggagattacccatctgattgatctctcgcccggtgtttcagagtttattgaaaattccgggagcatcagatttccaccagtcaatcaggtcagaatgcaaggaatatctatctgttctacctgattctccggctaccggtgatagggaagacctctgataatggtaaatgcccggtacagttgctcatacaacaaaagccgtgcaatttgatgaggaaaggtcatagcagatagcgaaaggatgatattccctttctgaaggcaatcctttgataatccatgagggccacctatgataaaaaccaattgatatggcccttctatctcgcagcgtcttattacctctgccagcccctcactggagacctgcttcccggtccggtccagaataataacataatcaagcgagtctattccggagcagagtttctctccttctgaaacacatgccatttcaatggttgagggatgagtatcaggcacaggcgcttcaggatattctatacattccacctgacagaatgaacacatccgtttcgcatagtcagcgatagcatctcggatgaatgactctttgatctttccaatcgcacgtattcttatccggaccatcagaaaacggtatcctcaaatttttcatgcttcttatgcaggtattgccataccttttctgacgaaataaacccgtcatcaaggcgatcaatgagcttatcaatcctatcaacctcatagaggatacgatccttttcaggagactcattttcatcaaccaacgtggagatgatggtcaatggatttctgatctgatcatttaaggcgcccatatgaaccaggttctcttcaagttgttggtaaagccgctcctggttctgctgaaactctacctggcgggtgatatcacgggcaataataaaaactagactattctcatgatatctgatatcccggatgataatatcgaaaacgacctgatctgagctggcatcagatatctgccctgaagaaaccggaaatgaccattcaaacctggtacccgatcctgcagggtgatccaaaatccgctgacagaatccatgaagcgatgatgaataccggttgtctatatgcacggaaagttgacacaaatcctgaccgatgaatgttccacgttctttctgaaaaatagcagaaaaggcctggttgcaatctacgatttttgtcccgtctaatacacagatggcatcctgcgcttgttcaaacagaattcttattcgctcttctgcttcagccagttcttcctgggtccgggcaagttcatcctgatgtttccgaagtgaggaggcggtgttatcaactgcctttaccagcggagtcagctctaccggggcatttgggagaatgcagggttgacaatcaggactctgtgatgaatccaggatattcgcaattccttggagatgaaaaagcagatatctgcggtaatacagaatgaggccggcgaaaaaaaggccgcacagaatggcggatgtgaggatcaaatatagtatcaatgaggatgtatagggagttctgaatggtatttcagttttcacaaggtatgcaggattgtcccgaatgtctgaaataacgctgtatatgatgaacttctgacctgatggatccagttctgcatacgggagagaagctttgacatactgttcccgatctgcataagttccaacaatctgaaatggaaataccgaattatcagatatctccataatccggtcttcatcaagatatcttccaaaaatgagatatccttcctgcgggccggtctcatcactccggtagatcccttgaaccgcgataaggaccggaccggatttcagagggatgataccagtaatcggatcaaccagatcaggatcggtgagaagctgatatcgcgatatcaaatcaaatacatcatcaggtatgggaactgccgattgcttttgagaatcataccccttctggaagacaactcccccggttttatttaaataaattgcaagatcaagttgtgatgctgaaaaagttccatcctgaagatttgactggatatactgatagttcccatcctggacaaactggtaggtatcatcccataccccccagtcatgggtaaataatgacaggctcttctcttccatcttcaggatttgaacgaccttttctgcgacttccggagcagttgcacgttctgcatcagtaattccctgcatgaccgtgaaatgcgataccaataatactccggagataagcagagtagagaatataagagttgccagaataaggtgcccgaatacagactgtcgcatggagatctccagaatgagtaacaattgcgattacatatttctattatcagccgttaaggttatgctgcaccaccagataatgaaagcatgagttcaatgacagaaaaagagatgaacactggcgatccggctccggatttttcactcccggatcataccggaaccatgcatacagctgcttcataccggggatcatggtacatcctctacttttatccgaaagataatacaacggcctgcaccgcagaagctctggctttctcagcagtctatgaagaactggcagaacttgaaattccagttatcggagtaagccctgacaccatggaaagtcaccggaaatttatcgaaaagcatgatctcatgataacattacttgcggacgtaaaccatgaggtcatcggggcatatggagcatggaaacgaaagaagatgtacggaaaggaatatatgggtgtcgagcgttccacctttcttatcgatccgaatggaatcatccgggagatatggagaaatgtgaaggtgaaaggtcatgtcgaggcggtgaccagcagacttcgtgaactaaaagctgtcataccctaaaagacttcaaccccgtcgtcaagtggttcaataagacgctccccggtgaaggcattaatctcgactatctttttccccttgatttgccacaccggaacatagagctcacgaagctccagcgagatgttttccggttcaggggccagattcttctcttcatagaagatggcatcacctttcacctgtcttatccggactcgttttgtcatagaactaatgagatgactggtaatcttcttctctgcttccgcgtgggatatcgagggtttggagatctcactcccctccgggatctcccgccgggttatggtatctccgtcaatatcaataagcgcgccattgatggcattcatcgcccctgaaccgctcccgtcaaactggatattctgatccttataaccggcactccctctgcaggtatacttaaacatccagcacggaaggaaccggagggtagccactccggggataccggccttctcctcagcctcgtcacggtggatacggaccgggagatgagggatcctgacgccgccttctgactcgtgatgagtccgcgctttgtatgaaccagtctcttcactgccatccagtggaagaaccagtgtctttcccaggacacgggcgagcactgcttcaccggcatacatcgcaaactcctccgggtaccagacaatacaattatctgccgtaattgaaggattaaacgtcactagaatcttttcgcagatcttctcttcctgcccgacgcggatagtatactcggtttcagagtatgaatctgccgcacccggatcatctgaacacatgaccagaagataggtattattcctgattgcagacagatccaagggtgctggtgcagtatggacgtcaaatcccgctgcctttaggatatctgaaactgcacgtgatgccttttccctggttcgctgctccataccgtactgtataccgtccaaaaaaagaatatttttctatctccgggctcgtacaatgagtcatgagtgaattcctcaggtttgtcagtcaccagattgaggattttgctatgcaggtcacattcaaccctgttgagggtaccgggactgttgtgtataatctctcactcgtgcgtgtcgaagaccttgagcagacaatatcagtgtttcgcgcaacctgtgaagccggagtgtcaccaagcagccttatccggattctctatgcgggcgaagaactggatggatttgtgataccacaaaatttctgcggcatcctcaccctgtgtagtacaacccttgacggccttctcctccagcgggggataccctccaatccaatcggtggtggtgttatagaagttgcagagaacattcccaagcggtttacccatctgataaaatacgaatataccacgatagatccgcttcaggtgctggtgtcccaggagataacatcagtccaccaggtcatgaaacacggcaacgggagtattcttgggaatattcgtgaatgccacatggaagcggaggatgatgtggaagaggttcttgatgaactgactgagggttattttaccggcatactggacctgggtctgccaaatactccctgccttggagtggctgttgatccccagtacatgggacttgccgcccttggtggtaccaactggatggctgcactcagggaggagggtatatcggtgaccatgcaggcaatgaagggtctgtgtgacatctcaaccatggaatttgtttcacaactctagagaactaagtcgtaatgcgtatatttttatttatgaggagtcgatgaaattacatgcagccaatcccactcgtaaacccggatgtcagggactgctctgaacttctcacggtaatggcagacccagactgtagaaccggggggccggcatatgagatgttcagggggctttatctaaatgatccggataaaaagtggctggaggagcacaagatcagatatgatataaccaggattcccggacaggtgatctgtggagagtggataaaaaccaagggccattatcaccagtctgctccggacgggtatgcatttccggagatatatgaagtgctggaaggggaggcattgtacctgcttcaaaagattgacctctcagatatcatcctggtgaacgcacgaaaaggagaccttgtcctgattcctcccgggtatggacatgtcaccatcaatccgtcagaggatacccttcttatggcaaacctggtttcttccgcttttacaagcgaatatcttccatttgaaaagatgcagggagcagcatattatctgttcgccgatggaagaagagagagaaacccacggtatccggaaacaatcccggaattgcgtgaggtaacctgctatggaaaaccgctccccgaaccttttccacaacaggcactctactcctgtgtgggagatgaaaagagcctggcctttttgaataatcccggctcgtttttaaaagagtatcaggaactttatctttttatgtgaggtgcgggtcgctgtttatggcctgcccgatgaattttttccattactctctgttcagcagggctcttcggtttccatccctgtttttcaaggttggtgatggcctcatcaataaccgcatagggcatacccagttcatcttcatcagtctgattatgccatagtcctgcggacggggttttttctattaccttttgagggagtccaagatatcgtgcaagatcccagacctgagtcttaaggaggtgcatgatcggctgaacatctgctgcgttatcaccaaactttgtgcaatacccgaggagatattcagtataattagaggtcccgcagaccagccggttcatctggtttgcataataatacagcatcgtcattctggttctggccataagattcccgaccaggtatgaattctcagtaaagtccggcatccttctgtattgatcaatgaccggcccgataggtatcgtcattaccgggatatgaagagactcggcgaggaggcgcacatcggcagcatcttctgaaggagtaactgcggatgggagaaaaaacccctgcaccatatcagaccctgcggcacgaacacacagggctgcagcgaccgctgaatctataccacctgaaagtccgataacaaagccctttgaagagcctgatatgagtacatcctgaagaagcgttatgatggaatccggatccggagaggtgcctgtcatacctgctcagtagattatcagaggaagaaaaaagagtgcctgatcagccggtcctatgcaaatgatttttctcaagatcacacaggcgatcctggtacctgataagagagaacggaacggaggggtgatttcgggtaagagaagacaggaaggtatgaacatcaggatcaggataagcctcgttttcgatagggatgttcatctcaggtgcaatacgtcgcagttcgtcaagagggatctcgcgaaagggcctcagacagagaaccggggagaggtcaggatcatgaaggattgaagtccaactccccgagagcaaagagcccagtacctgttccgcctcttcatcaagcgtagtgcatctgatcatacgatctgccccggtcatcagtacactatccctgatacttcggccctgaatttcttctgttctgataatgatggttgaggggagatgaggtaagatcttagaaacctcagggctatcgcacccattatgcaaaagaacgagctccatcccaggtcgtgttccaattacctgcaccagaatagagaggagagagagacatgcctgcccctcccatacgatagcaagaactggtcttttccccagtcctccatcaagccggatacttcgctttactctgaccagaacatctgcagcaagatggactgcgcacagataccggcctgaataacgctgatggatgacggacggtgccctgcatctgacacagggttcacgggtatggatcacgctcataaaatggtatccaaaatgtctgatagtcctttacaggttttcctgcgatcggcatgaactcttggacaaatctttcgaatctgggaataaattatgatctgatacgatgcactataacatacccggattataaaatatacgtaaatggacctttctgcagaccatatcaaatcccttcataaatatgaactccgcattctccagtcaattgaatacctcatgagcaggtattcctgggtaccggaagaggaactggtccacaactcccgcctttctgccaatgaagtccacttcagactttcaaaactgatggagaaaggaatggttaagtattcacaggtcccgtatcccgggtactgccttatttttaacggatatgataccctggcaatatctcatctggtaaaaaaggggattatcagttcacttggatcctgtatcggtgagggcaaggagtcacgagtctatgaagcactcggaaccggcccggttatcctcaaactgcaccggataggacagcgatcatttcagacagttcggcggggaagaaactaccttcctgaaaagcagcattgtccctgggtgcttgcatcacatttctctgccgaacaggaatacctcgccttgtgcacgcttcagaaccatgtcagggtcccaacgcccctcctgatgaacagaaatgttatcgcgatgacatatatcgcaggtgaccggttatctgactgcacgctggaaaatccgcgggaagttttggatgagataattgcccaggtcagggcagcatactcgcgtggctacatccatggtgacctgtcagagtataatgtcatgtttgacggcgaagagatctggatcatcgactggccacaatgggtctcgccacatcatgaaaatgcatccgaaatcctggaccatgatcttgagaccatcacaaagttctttcaccggcggtaccggatctcttctgatatgaatgaagtcaggagtctggtgaccgggtgctgatattcggaatcgatctcataaccggatctgtaagatcccggaccgtccagccaaaatatgcattggtactactcaaggacggcgatattcaaaaagaactctcagtctcgctgcaccggctggtacggctggttcatcggtatcagccagagatccttgcggttgattcggtccaggagattgcaccccacacacaggatctctaccgttttcttgaacagcttccgtcaaagacaaaactggttgtagtcaccggaggagatcgtcaggtcggactcatccaggtagctgcacgatataatatcacctttgaccggtttgatccctttgcagaagcccgtgccgcagcccaggtcgcctttcacggggctggtgtggaagttgttgcatttgaaaaagagaccgagattaccataaccagaaacagatctccagggaaaggtgggtggagtcagaaccggtatgcacgaaagattcatgggaatgtactccggtatgcccgtgaagtggaacaggacctgcagaaccgggggctctcctattggaaaaaggagtataaagcctttggcggtgtgtccagggtaacctttcatgtcagggaggaccgtgaccagatcccggtctcatcctcgcggggcggtgacgttcagatccgcctgtctggaaaacaccttgacaggatccaataccggccccttaccgcacggccgaaatatctcatcgtggggattgatcccggtaccaccatcgggattgcagctcttgatctgaacggagaactggtcaaagtccagagctcacgccagatgaccatggccgatgtcatcgagctgatctggtccctgggaaaaccgattgttgttgcttcagacgttgttcccatgccctttaccgttgaaaagatccgtcgtgcattccaggctgtcccctataccccacgtcaggatatttctgttgagacaaagtatgagctcgccggcaaatacggatatgggaatgatcatgaacgtgatgcccttaccgcagctgctgaagcctacaagtactggcgacataaattttcaggaatattaaaacgagtgccgccaggtgttgatctcgatgaggttcgtgccggtattatccgtgggcagtcgttagagagaatcctcagtgaaagaaaagtgccggttcggactgcactggagaagaaaccggaaatcagtcttgatacaacagacgaacgggtcaggatactggacgggacggtgaaagatctgagagtcctggtatcggatctgcaacaggagatcttatcactgaagcgccaaaaccaggtattatcaaagaaaatagccgaaatgaagatagaacggcaaaagggagtcaacgctgaaccggagatcataaaacgggatcagatcatccaaaacctcaagcaccggctcaggcaggaagaacgtaacaataaaaaactgcagagaaggctcaaaaggatgaaagagacgacggatgaactccggccacaaggtaccagggcgataaaagtgcttccagacctgtcacgtgagagtgtgcgtctgcttatcgaacgggtcggcatccagccaggagatatcctttatgtcaagactctcgcctcctggggaaaggggattgttcatgatattgcacgaaatggtgttgaagcggtcattgtaaacgaaaaagcagcggatactttaagccatgaactccgtgatgtgttcctgcatgagaacctgcctgttgtagtttcaaaagatatgcagatccaggtcaaaggagacatgggaacctgtgacgaagaaaaatactccgaggcacttgatgactgggtctgtgaacatgacaagttcctgaaggggaagagcgaggagatgcttgagtctttgatgaaggaatacctggcagaacgtgaacgaaaggtcaagtaaccatggacgatcgtgaccttctggagattataagaccagtgtgcgggagtgatacctgttctgatgattgtgccatacttacccttccctgcggagcattggtcacatccacggacatgcttcacgaacgctctgacttccctgccgggatgaccgggtggcagatcggatggatgtcggttgcggtaaccatatctgatatcgccgcaatgggagcggaacccctgcagatcgtgctcgccattggtctggatacagaggagcgtctggcagagattgttcttggtgcacaggcctgctgtgatacatatggggctgtgtatgcagggggagatcttgacgcacactcagaacttaccattgtctcaaccggagtcgggatcatcagagatggagagccggtcaggaggggtggtgcaaaaccgggagatatcatctgtgtaaccggtacccttggaagagccattttgggccttacgggggacagccggttctggaaagatctctgtgagccacagccacgagtcagagaggggactgttgcccgactggcgggtgcacatgcgatgatggatatcagtgacggacttgccatatctctctatgatatcgcagcagaatcacatgtgggaatggagatatcatccggacgaatcccactcccaccagaagcagatgtacaggtggcattagaagctgcattatatgggggaggggactttgaactgctctttttcatttcagaagaaaaaatgaagaacctgaccattcctgtaacacagatcggccgggtatcagaaggccttaaaattacaatggatgggatggaactcccgaaaaaagggtaccttcaccattggtaggaataccgccagtagttccagttattggagaaatatgtcactccctgatagagggaatcatagaccctggctatatagagattctctccaatcttcttgaaataggggaatgcctcctggacttttcccattttgtacagggtctttcccattccatagagtgcatcccggttatcagggttcaattcaagggcttttgaaaagtctttatatgcattatccaggagatcgatcttctgatatgcagcaccccggttcacataatacaccgactgatttggatcaatcttcaaagactcattaaaggcatcgatagccccataataattaccctgctgaaatcgtgcaaatccgagatttgtccatccttcagtactttgtggagagatcctgacaacctgggcgtatgcatcctcactgatcccatattcacttgcaagatcagcggcatacccttttctcatccatgcaatcggaatatcgggattttctgcgattgcccgatcatagtaatgaatggtatcatatgcctggtttaattgacgcatgacttctaccagatacttgaatgcgtcttctttcatcggattaatctgaagagccgtctcgaatgcttcctttgcaacatcatactgcttattcactgctgctacatcaccgagaaggtaccaggcatcatacgaatacggagcgagtttggttgcacgggtagcagaccgctgtgcatcatcccgtttcccaagtgcaagttcagcacgtgctttctgcatccaggttgccggatcatcaggatcaatcatggttgcgttctcaaaccggtacagagcatcctgataccgtccggactgcatcagtaaaaatccgacattcgtgatagtaataggatcattcggctgaattttcaatgattgattaaacgcatcaaaagatgcatcaaatttcttcaggttggcatatgaaaaaccaagatttgcccatacatcggcattactctggtttaccatgagggcgctgcgtgaaatggctgctgattcatcaaactcccctagaacattctgaaccctggctaaagccacgaggagatcaacattctttggatcatccttgaccagctgtgcataaatttccctcgactctttgtattttccagttttctcaaggagttcggcctcaataaacagattatcaggattatcaggaatcagggtattgagttgtttataagcaaccgctgcctcttccagacggtttgacaaccggagcatctcaccaagacgcttccatgatctggcatctttcaaattgagctttaaggcattgtcatactctttagcggcttcattatatcgacccgagtcatacaacagttctgcctttttcacatgaaactcgtaatttttcggactcaggttaatggcaatcccatattcccggagtgcctgttctgtttcattcagtgcagagtaaatatctccaagacctgcatgagcctgtgcattccggggatgaaaagccgttgcattctttaaatcagccagggcactcatcagatctccattcctggcatagactgcacctctcccgatgagtgccgagctgttttcagagtctagggtcagaacatgagaatagccgataattgcctcggtgttcattgattcattgaataaaagatctgcggtcttcagccagagacctgcatcagatgaattcagcctgattgccgcatcatagagggacaaagcctccattgcactaccattctgttctttatcctctgcctggatcgtaagatttgtagagatattcgtaacatcaattggtttatcatctacacatccagcaaacagaagatatccagtaataagtgtagtaaaaagtatacacttcagaaatttcagagtataataattcgacattcaaatcagataaaaaaagttaaaatccggtattataggggacactttttaccagataatatgccccgttaatatcaagggtttctttatatccacgctcggtcagatacccctgagaactgttatacagggtaatttcatttgctttaaatgaggcactcccgatcgcaccatctgctcctgagggcatctccacccgatttcggggctccgggtaccatccttcaggaacttcctgcctgacgccggatccccgttcatggacggtgatgtaatccagttcacgatcagtacttccccacatgaaatcggtcagctggcccctgctggtattcagatactcatccatcggggtttcatatgagtaattagaatacacggtcagcgagacgtcatatttccctggttcacgataggtatggacggggtttttctcagttgacgtattcccgtcaccaaagtcccagagtcgggcatctgcaaatccataactgatatcataaaaccgtactctgagtggcgcatccccttctgtccggtctgaggtaaaatcagcagcaagcgttgagacaacaaactcatcatatgacgggtgacaaccacgggtaaaaccgggtggagaaggaagcatggatggttttaatgtgtatgctgcctgcaccatcgtgcacagtattatcataataataaaaaatccaagaaggtatctccacctggctgatgtcatagttttattcctgaggtataggtaaaggacttcataaagtttacaattgccccactcaccatggcatgatcacgccattcatttgttgccgatgcattcacgtttgttccccgcccttcaaggattgaacctctgaaatcggtgatcaccgtaccgattgcagcatcagtgccattgataggagctatacttaccatatattcaacaccggccggaacgccatcttcgccgaccgcacgaatcttcagttttgattccatcgcaaatgactgcatgtttaccagtctcgtcgatccactcacatggtcatcaaaagcaggtgatacatcatacgaatctgcagttatcagaaccggagtggtgaaaatgaaaagtatgaggaagatgaaaacgcgaatctgcgtcataatattcacgcccacacgtttgtcagcgtgttctaatatgtttcctgccagagggatttatgtcggggagagacccgacgtaacggtaaaggattttccaaaggtgaatatctgaccatcaaccgttgttttgtcattcatcttcttggtggatgcaaggtcggtcgtatttgttggtgccccttcctcattggtcattacaaactcggtgcttgctgttccggctgcataggggataccagatgacatgtccggatgaatgccgataagataccgaagttctgccgggatggtattgtccgttccaacagagcgggcccgggccatggtcgcaatctgaccgctggtcatgtcaacagcagatgcacctttgtaataactattgaaccctccgacataatcaccgatgatttcggcaacaagcggatttcggacagatctgtttactttggtgtaattacccgagttgaacatctcaagcgagtctgaggctgtcatcttacttccaatctccggatcggtaagataggtggagactatctttgaatcaacattaaaggcccctttctgttgtggcccctcgtcgatcttcaggcccttgctctgcgcaagatatcccccattggttgccatatcacttttataaaccacggatgatacccgctcaccatcatagagaaaaccaccctcatgaccaccatggctgctggtttccagctgatactcctggtgagaggacattgaaccaatcacttcaagataggtctctgaaggaatctgcctgttcgtggtattggtcccgttcggaaggatatctgccgatgcaggaaatatgaataataacaccaggcagatactgattaacacaggaattttcgtattcatggacggcaccggaattatcttcataggtattggaatgaatactatagaagattgccggaaaaagaagacgcccagatcggaattcgaatccgagtcgtcggcgtgacaggccgacatgataggccactacactatctgggctgggcatatcccgcctcccggatttgaaccggggacatcgcggtagctgcgctcttgcctcaaacggcaaatcagtctacagccgcgcactctaccagtctgagttaaggcgggattgtgctctataaggtggtagacacaaccatatatagatatctatttcgcgggctgatactggtgcagattctgtccagtcatgggcatgaagaggcatcctttgaaaaacctctattacaagtcaaatggaatacgtactcacaggttagtcttcatgacgggagttccagatattctttggcttgaggagatccgtaaagaggatattccatcagttggcggaaaaggtgcctcacttggggagatggcctctatcgggcttccggttccccctgcttttgtcgttaccagccaggcattcagacgatttttagtccagacagggcttgaagagccactctataaaattctggaatcattgaatgtggatgataatgatgcgcttgaatctgcggcacaaaaggccaaggatctggtccttcaggcaaagatgccagaagacctcaagagcgagatagggatcgcatatgaaaaactctccaggacaggtgatgtcgtagctgcccggtcgagcgcgactgcagaggatcttcctgatgcaagtttcgccgggcagcaggagacgatcctgaacattaaagggattgaacaccttctgaaaggaatccatgaatgctgggcctcactctatggtgcccgtgccatttattaccgggcaaagcaggggtttgatcaccattctgtgaatattgcggtggtagtacagcagctgattccttctgaaaaagcaggagtaatgttcacctcccatccggtgaccggtgaaccattagccatcatcgagggatcctggggacttggagaagccgttgtatcaggagcagtatcaccagacaattacgtctttgatcggagacttgagcggacaattgaccggctcatctctccaaaaatgatcgagatcgtcgctgatggtacgtatgggaccatcacacgaaatgtggagaagtcacggcaggaacagcagatcctctctgatgatgaggtgaaaagacttgcaacctatggtattgtctctgaagagcattacggggttcctcaggacatggaatgggcgattgtgggggataagatatacatccttcagtcccgccctatcacaaccatcaaaggtgcaacaggcatgaagaaagaaacaaaagcaggttctgctgatacggttatccttcagggtcagggtgcatctccagggattgccagcggtccggttatcatcattgaggatgtcaaagatatcggaaaggtaaaagaaggtgacatcatggtcacccgcatgaccaatcctgatatggtcccggcgatgcgtaaagttgcagccattgtcactgatgagggaggaatgacctgtcatgcagccatcgtctcccgtgaactcgggacaccggcagtcgtaggaacacgaaaagctacccaaacccttaccgacggacaggtcatcaccgttgatggtgagaaaggcctcatctatgacggggtaatcgcccagcagactcctgacgcaggaactgcgaaggtccagatcgcctcggcacccgccaagattataacagcaacatctgtcaaggtcaatgtctcaatgcctgaggccgcccagcgtgccgccgcaaccggtgctgacggtgtggggcttcttcggattgaacatcttatccttggcctcaataaaacccccaactggtatatccagaaccaccgggaagaggagttcatcacagaacttatgaacggaatcaaggtcgtccttgatgcattccccggaaaaccggtatgggtcaggactcttgacgcaccgaccgacgagtttagaaacatgcagggcggggagaacgaacctattgagcacaaccccatgcttggatggcgaggaatccgcagggatcttcaaagcccggcacagttcagacttcagattgataccttcaaacggctgtgggaccttggatatgataaccttggtatcatgttcccgatggtatctcatccccgtgagtttattcaggctaaggaactcttcagacaggccggcgtagatgtcgaaaatgtcgaccttggtatcatgatcgagattccggctagtgcagtccttgttgaggatttcatcaaggcagggatcaaatttgcatcattcggaaccaatgacctgatccagtacaccatcgccattgaccggaacaatgagaatgtcaccgatatgtactggccaaaacaccctgcagtccttgccctgattgatcaggcgatccaggcctgccggaaaggaggagtagaagtttcaatctgcgggcaggcaggaagtgaacctgacatggtcacctggcttgttgaacacggcatcacaagcgtctcatccaatatcgatgcaattgccaagatccgcgagaccgttgcacggaccgagcaacggatcatccttgatgcggcgagaagaccttatggatgctgaagggctctcaaccgacgaacttttttgttttttacaggcgaagcggaatgaggacttttcctattcgcatatcctctcctccatgtgtacaacaccccatccggtagcggtacaggcacataacctctttatggagacaaaccttggagatcccgggttatttccgggtacggccacccttgaggaccggctgatccggtggtttgcagatctctaccatgagccatctgctggcggatgcacaacgtccgggggaactgagtcaaatatccaggtgctgagattttgtaagaaaacaaaaaatgtgaaggaaccaaatatcatcgtccccgcgtcggcacacttctcatttgagaaggcatgcgggatgatggatattgagatgagggtggtcccggtagacgaacaataccggatgaagaccgatgcagcaggagaactcatcgataagaatacctgctgtattgttggtgttgccggaaccacggagtacgggatgaccgaccctatcccggcccttggaaaattggctgaacaggagggagtccatctccatgtggatgcggcgtttggcggatatgtcctcccctttcttgatgatgcccccccctttgatttttcagtccccggagttggatccatcgcagtagatccacacaaaatgggattaagcaccataccgtccggagtcctgatggtgcgtgatgagcgggtcttttgtaatctcctggtggagacaccatacctcaccacaaagcaggcatacagcctgaccggaacacgacctggtgcatcggtggctgcagcatatgccgttatggcctatcttggacgaaaagggatgaaggctcttgtcaccggctgtatggagaataccaggcggatgattgaaggcatggaggcatttggtgttcacagaaaggttaccccggatgtcaatgttgcaacttttgagcatgtcagtgttccctccccttgggtggtctcatacacacggaaaggcgaccttcgtatcgtctgtatgcctcatgtcacccgcgatgttgtggaagcattcctgtcagattttggagaatcatatgtatcccatattagttaattcacttcttacctgcccgattgttaaaaagggcgaatataactattttgtccatcccatcactgatggaataccagatatcgatcctggcctgcttcgggagattgccgttggtatgatccgtcttctggatcttactgatgtgaaatatatcgtgaccgcagaggccatgggaataccgattgcaactgctatctccctcatgaccgatataccggtgaacatcatcaggaaacggaaatacggccttcctggtgagtgtgatgtctgccaggtcaccgggtactcgaagggtgagatgtatatcaacgggatctgtacaggggatcgtatcgtcatcgttgatgatgtcatcagcaccggggggaccatgaacgggattatcaaatctctccagagtattggtgcagagatcgcagatatcggctttgtgattaagaaaggaaatcccagtctgaagctcccctactcctatctggtctccatagaagtgaccgaccgggtgaggatcattgatcagtctttctgacctgcatgagcggctgaaaaccaggggatgtcatactgtggcactccaggcaccggaggggttaaaacgatttctcccccggcttgcccatgacctgcgccatctcgggtatgaggtcatcatcagcggggatccctgttatggtgcctgtgatcttgaccttcgtgcacgggatcgggcagatgtgctggttcatatcgggcatacaccggttgataacacgaaacaggttatctatgaactttggccggttgacggtgacctcacggtaatcagtgacgttatcccgcggctgaatgggagaagggtcggactggtaacaaccatccagcacatccatcttcttccaagggttgctgaactcatcagaaatgccgggattgagccggttatcgccgagccatcaccacggaccccctgtcctggccaggtgctcggatgttcgtttaatgctgcacgaaagacagggactgatgagatcatctttctcggaaccggccttttccatcccatcggcatccaacttgcaaccagggcacgggtatttgcctgtgatcccataaccgggaggattgaagagccggatgcagaccggctgctcagggttcggtttggccttatccagaaagcacaaaatgctgaatcctttggcatcatcgtctcatcaaagaccggccagtgcagatctgaactggcagattatctctgtactctttcagataaggcataccggatcatgctcggagaggtatcgccagaccagctcctgaaccttggatttccctgttatgtgaataccgcatgtcccagacttgcatacgatgaccaggtcaggttctctgtgccggttctgactccctgtgagtttgagatactctgcggggtcaggaaatttgaaacgtacgaagtggacgagatatcatgaaactcaggcagcttgagatgctgctccaacgggtctctggctttgataatccttcagcagaacgggaacaatatcagacaccggcaccacttgctgcacgactcatccatatggccatgcttgcaggagacatcactgaccgcacggtactggaccttggatgtgggaccggcattctggcgattggtgctgcacttctcggagccgaagtcgtagcggttgaggatgatgtggaagctatcaggatagccgaagccaacgccagagaccttggatgcagcatcagatttatcaaaaccgatgtagccggtgaggaggccctagcccttattcctgattgtgacacggttatcatgaaccccccgttcggggcacagaccgaacatgctgaccggccgttccttgacatggctcttttgaaggcacatgtcatctatgggatctttaatgcaggatccggcccttttatcaccgaatatatccggggtaggggcgagataaccacttcagtgcttgcaggccttacgataccccggaccttctggtttcatacccgtgaccggtatgagataccggttgagatacacgtaatcagacgaaactaaaagagaatatctgtgcagagactcctctgcatctttttttaatccttgacgaggataaaaccgattccggcgagcatgataccaatgagcagggcaacaatcccgattgcacccttgacgacattgatgacatcaggaaggaaaaaccagataccataggcaccaccaatgacaagcaggatgccgacaattaacattccaagtcccattttatccatatagattatcctccagtcttgaattacaatacacgtttgtttcaaggatagtaataaaccattcccaaatatcggatttttaccttgactttgaccacatcagtcttcaggggagaaatattctgccaccagcagaacgcacacatctgcaccaccggcgagaagggttatcatctccctgggcaaatcacgggcagtacggtcagcatagataccaatggtccgcccgcaggtgaaggatgaacgtctccagaccaggtcagtcggatgagtaagtgaaagaccgggatctccccgtgaagttatctgcacttcatacgggccgcaactcagtgtggtggtaagccgacaatccggatggtgcaatgcatcacgaaatctacggctgagatccagcgctcctttgtcagctcccaccgcgataatacaactgcctgccagggaaagttcatcctctttcgttatctcaaaggttgtgcgatgagttgcagttacattcggatgcccgtgagcagtaagatactcctcttccctgaccatgtatttacacactctcttccatgtgtaatcaatggatctggtagatgcctattgtgcaacttgtaaagaagagacagaacaggaggttctgagtgaatcacgcgatctcatcatccgctgcaccgtctgcggactgacatcccgaagacccctgccgcctgaacctgaaccggtgtatatcaaaaccatcgtcagcagagaagccgaatcattcgtcgcgaaggctgaactgatgaaaggagaggttgtcgaagtcggtgactacatcgttgccgaacgggatgacggagagggcgccggtgtcgagatcatgtcactggaagttggtaataagcgggtacagaaagccgttgccgaggagataaacaccatctggtcacgggcaatcgacgaggtcattgtcagaatctctgttcatgacggaaaaaagacaatcccgatgtacgttgcctgtgacggggatgaccggtttacgatagatgagattgtatccattgaccgggtcagggcaagaatcgatcatatctgcctcaggaacggcatgattcaaagaagaaaaggaaaatatgaagtggcaaaccgcatcaaacggatttatgcctaccggctatagccggttttatgatgttgtcagtttggtcagtgtgatctctaccgttggatatccgtaatttaacgtgatatttgctgcatcccggtcaataacggttgcagtcctgatatatgacgtcggggttgcattatccagggggatctgtggctggtcaatgaatgccagtggaacctgatctcctttcttgacatttgcaaaactctctccggtgatattgacaaactgttcaatgctcatctgcctggacatctgtcctgcatacgggtaggtcagaacctttgaatcaccaacacccatgccggcaatcgagttactgatcatatcaacctcagggccgaagagaccaaactccatgactccgtattcattatacgggtttacgacctgaatcggaataagatcctcgcctgatgagacattgactctgaccggaagtgaatttgccttaaaggtcatgaccgacgggtcctgtgccttggtgattacagaaaggacactggttacgaccggacggtcctgcgcgtcacggaaggtaaaatcaacgagtgcagtgtttcccggctttgcctgagtaaagatgttcagccatgacataccgaacattgatacaaccataaagacagccatcagaacacagactgcgacgattccaattttcgtccagtttgtctcttctttcttttctgaaggctggtggcggaatcctttcattcctattacgtaaaccctgccggaagataaaggatgcaacttgatattgaccggtcaggtatcaggatatttcccaggttttgaaacgatggattcatacctgcaaacggtgagtagattcgtatggaaaaaaagagggtccgtgattacatgaccaccgacgtggataccgtcgctctgacggggaccgcgcgagaggtaatccatgcaatcagggtcacctctcatgacgggttcccggttgttgacgggaatgttgtagtgggatatattgctgcacgggatctcctgtttgtgcacccggatactccggtcagagagatcatgagccatcatctcatcgttgcagatcccgagatggctatcagcgatgttgccagggttatcatccgctcaggtattcagaaactgccggttgtaaatgagaagaatgaactgcttggcatcatctccaatactgacgtcgtgcgatcccagatagaacatgtctctccagagaaggtctacaaactgatggataccatcgaacggctccatgagataaaaccacacctgtcaaaaggaccggtccaggtccatatgctccttcccacccagtctcggatctacatggacgaactcgaaggcaggatttatgagattaaaaaaggacttgctgaaccggtcatcgtgataaaaaagccgggccgtcttatcctggtcgacgggcatcaccgggcggtcgctgcaagaagactcgggatcaagattcttgaggcatatatcatcgagatcctggaaaatctggaacttggtcttgagcggacggcaaaagcgatgaacctcaaaaccatcgatgacatccagatcatggactatgcccgccatcctcttgttgccggaacacaccggtttggaggggtggggaccgtagtccctgaatctcaggatccctcacaccgcgtatcataggaatcattgagcatatgttcggtcacggtcgttccatcagggatcaccatatccggccagatgcgggtatttgagtgaacagtcacccggtttctgataaccgtccggggaccgatgacagacccatgctcaatgctgcatgagtcaccgatcatcgcctcattatcgataatcgcacctgacaccgacgttccctgcccgatgaccacccggttatagaaggaagaggagaggacgcggacattgttccggataatgcagttcttccctattgatgtgtatggcccgatgaggacattgtccccaatagatgtcccgctcccgatagcaaccggtccgatgatccgactgttatgcccgacatagatggatccgccaaagtctaccggaccctgaatgtgggcgtttttgatatccatatcaccggagatgtttgcatagctcatctcctggagtttccatttttctgcaagccggagggatgccgggcttccgacatcagaccagttcccccgtgcaagccatccgtcaaggatcatgcccttttccatgagcagtgggaagaggttttttgcaaagtcgaacttggtcccatcaggaatgtaatcaaagatatcaggagaacagacatacatcccggttgaggcaaggtttgagaagatctcacccggaccaggcttttccctgaaccgtcggattctgttatccacatcaatctcggctatgccatactcggagggatcatcaacactgataagcccaatggtgataataggtgagtgtttgagatgttcgcggtaaaattccaggagattgatatcggttaagtggtcaccgccgacgaccaggaatggcttttcaccaaggagatgacgggcatttttcacactcccggccgttccgagctttgtctcctcatacacgtaattgatggtagcaccgaacagggctccatctcccagcgcctgctctattgcatcgctcttgtacccgacggtgatgatgatatcatgaaatccaaggtttgagagatgggataccagatgctctattgaaggtttgttaacgattgagatgcatggtttcgggcgttcaaacgtaagcggacggaggcgtgttccctcgccaccgcacatgatacagaccttcatatcgagtatgtaggatctgcggacatttaaggatatgacaaatgcagggtttcaaaacccaaaaatgattacagactgtccagactgaccgagtcaaagtcctggacaacctcagagatatccttaacgccgaacgcggttttcacggcggtaatctcgagctctgatgcgatgccacacatataatcaagcacgtcaattgagagttccttctttactttactctgttttaactgctcgaccaggtgaccgatcatctccacgtcttcaccacgaagcttggcaaggctgatgacacacatgtatatccgggtcagattcctgtcggtacccgtgatcgtgtcaaagaagttctttaaaacctgggcctgatacacctcgccgcccatatgtaatccattatattagttcattagtataaaaagatgcggatttattttgcggtactgacgatcttgatgatatcgccatcttttaagactgcactctctttaatccgcatctttgtctttgcatcgattgcatacaaaaatccctttccaatatcggtatgcacctggtaggcaagatcatgcggggttgatcccttcttcatcaggaaggcatcaggaagaaccctgccctgaccgtctgtcagatgcgtctcatcctcaaccggatacaggacgatcatatccaacagctcaaagaccgcccggttgatgatctcctgcactcccgtaccgccatgtgcatccatataggccttcatcttcataagacctgctttctgggcatcgctcagttttcccttgtcaggaatggagaaggatgcatcacccggatgatagatgatcatatgcgatgcggcagcggtccggagagcgagttctgctgcgcccgatgtcaggatggcacctgaatccttcacctttgtgagtagttctggagaggcaagatctgccttattaccggcgataatcatcggttttgcttttcgcatcaggatttttgaaaattcaatcagatcaccggatgctgtcagcctgagctctatccctgcctcacgctctgcctccatcacatgttcctcctgaatggagaggccggcaaggatatcggcaagtcctgcatagatggagaatgagcgagactgggcctgtctctgcatctttggccaatgcttttcgatgatcccaaaaagccacatcgccatctcggtcttgagcatggggatctcttcaaggggatcatgactccccggattatccggatttccttcaatgtccgtactaccgctagcatcgatgacctgaatgatggcatcggcctgacgaaggtggtcaaggaactggtttccaagacccttcccggtatgtgcctcgggcaccaggcctgcaacatcaatcaggtggacggcaatatatctgatcccatctgcgcaaacgccacaccggtgcgcaagactggtacaggggcagggaacccgtacataggcaaccccccggtttgcatcaattgtcgtgaacggataattggcaatctcggccggtgccatggttgctgcccgatataatgtcgatttgccacagtttggttttccagcaagtgcgagggtgatcatagatggtcctcaaatcccagtgcgaactaacaggtatgtatgggatactgcaccaaaaaagtgtattattttgataaaccaggtgaagccaacaccagggatgcgatcaggattggtgctgaacgtgcacaggaacttggaatttccacgatactcgtgccaagcacgagtggtgagaccgcacgggtggcatatgaagaactgaaaggaacaccccttcatcttgtgattgtaacccatgttgtcggtttttcaaaccccggagtttgggagtttgatgcagacctagcagcagacctcagaaaagccggagtgacgataattaccggcactcatgtcctgtcaggcctggagcgcgcattttcgtcctcacccaaagtcagcgggggatcgcgaagtgaagcggttgcagaagcacttcgcaggatcatcgcggttggactgaaggtggccgttgagtgcacccttattgcggcagaccagggtgctatcggcgtatcggatgaggtcattgcccttggagggaccgcgagcggagtcgataccgtctgtgttatcaaaccgtctcacacccagagatttttcgatctccaggtcagggagatcgtcgcaatgccacgggacagataaattatgttatcagtattacccctgaccatcaagaatacgatgcgccatctcttcagaaggccgatcgtctggataccgggaatatacgcggggtgtattgcagcccttgtcatctggcttgagttcaccggcgggatgtttcttgccggaaagattgccatgctgggcgcaattgcattcccgttctttcttagtgtgctcaattatcatttagaaaccgatgagaagaacatgaagatcctggtcacggtcgcccttcggggttattttccgattgttcttccggtcatagtccttgctggtttcgttgtcgtgctagcactcctgctaagcgttcctctgtctatcatgggatatgggagtgatccctttgctctgaccgggctcatgctggggattggcattccggctctgctcttctcactctatattgacaacgtcgcggtatgtgagcggacaaagatatttggcaccctgaaacggagcatggaacttgtcacagttaaaattatcaccgccatctggttttttgttgtcagcgggattattgcagtaatcgtatccgtcttcggagcattcctgtggggagcgattcttgggagccggtttacccagttcattgagatgaatctgacccagcagcaggaggtattttcacagtataccctgaccgactggcaggctctcatcgggccggaagggataattgttaccgcactggtctttggatttgttacgtttcttctcgtaccaagcctgtttatcttcaaatacgagtgttatctggatgcaactgatgttgtctgggatttatcaggggaaagggatgaaaagggaagacatttcaggctttaaccggtttacccggtaaaaaaggatagtattgcccagagaacggcagtaattatcgctccccccaaagttgcaaggaaattggttcctgcattcccccacatatgcttattttcaaagagttctccaagcagactgtcaagattcgtaccgataaatccgccgatcattgctgcgacaaatagtgaaaagtcagcgactccgagcagcacaccacaggctgatataaagatcgcgccaaaaagtcctgctacctctcctaaaaaggagacgccaccatttgttccttcagggaccggctggagtgtagtaataaggcggggtttgcctgaacatacaccgatctcacctgcaacggtgtctgctgcagcagttgcaacactcccgagatatgccgcaatgaaaaccgggtgctgggtgacaccataaccaatagcagcgcagacagataccaggccattcgcaaacacattgacatatcccctggcacctcctttcgcctcttccacatggagcgaccttttataatccatctggtaccgggtagcaaccgccccaagaatgaaaaacgcgagcataatcaggaaccacgatatccctgcaaaaacgatgagaatgaccccgacaagggcagctgagaagagcccggggatgtcagcggtcttcagccggtaggcaaaataactaaacccgaaggcaatcacaacggcggttccgactagaggaaatgcagcctcatactcaagatcttcaataagaagcataaccagtgccaccaccaccagttcaatggcggttgcatttctctgtgaacccaggattgaatgaaggaggacacaaaccgttgcaccgacaacggcggaaagccaggattgctctcccagatactccatcacaaatgccgtgataagaagagcacagataaacgacagggcatattcaatagttttcccacccgtcagggagaagaccagctccttggttgtaacaatgaggatcgcagcatataaaacaaaaaccgggaggattccaataagaccaagcaccccgatgaacccgagtgctatcgagagccatttttcagctgttctaaaccatatagacagggcggcaatgataaccaggagtcccggaaccccggtcgggagatagggtgatattatcaggagaagaaccgccagaataaatgcaatccatctcactgtgtgcaacatagggtacgtatttagctagtcactcaatataatctatccagagcccttccgaaaccctataacctccggcatcgatgggtacgaaggagtcactttcctatgcaggatttcaatactggttacattttacgaagatttacattcataattgcacttatttttagtcttacattcatggtatcagcaggacctacctacgcaccaaccgagggaaaaaatcctctgaaagtatattttaccttccccggcggagaagagtgtgattcagtcaaatggaacttcggagatggaaatacatcaaaagcaatcaccacggatcatacctattactctcttggcatgtactatccgacctgctggtgtgaactccctggtgccaatacctcctatacgtatgactatgtatatgttatcccctggtcatccagtatcagggacagcatcaccggtggaagaccaaaacagaccgtggtaaacaggacatcagtggggcttgactttacctccttgaaaaaacaagcccaaggacttgctgccatcggtgagatgaggtacgcagccgatgcatatgcagatctgaaatcccttggaacacttgattcagaaactctcagctcctacggagatgtccttacaggtcttggacggctgaccgaagcagaagtgatatataatgaagcccttgctgaaaaggattcagcccctatcctcaagaaacttgcagatgtcctcttctctcttggaaagacgaaagaggccatcgatgtgatgaaccggactctggtccttgcaccggatgatgccggggcatatgcttcatatgcgtcatttcttcagaaggcaggaaaaaccccggaagcgcttgatgcgtttaatcagtctttcaaacttctcgatgcgcagcctgaaatctggtcggagtatgcggatcttctttcatcccttggcaggtacaacgaagcagctgatgcctatgaccatgcaataaaactgggtatgtttggctcagatatctggaacaactattcccgggtcctgcagaaactgggaagaaaggaggaagctcaacgtgcgaaagagcaggcgatgaatacctacgctccgatagctctatccaggtacagttccagtgacagtattcccacgtgcggtatcggctcactctgttaactcttctcctttttcatacgccctaaacaccagacatcagggactgacattccatcatctacattaccctttaccttcaaacgtatgggcaatgtctcgggtcttgcgggaacttcccaaaacctatgattatcgtgaggtggaagcacgatggcagcagacgtggaaggatgaagacgtctactttaaagaaggttctgaaaaaccacaatttgtcattgatacgccaccaccatacccaaccggggaatttcatatcggaaatgcattcaactggtgttatatcgactttttagccagatacaagcgaatgaaggggtacaatgtcatgttcccgcaggggtgggactgccatggccttccaaccgaagtgaaggttgaagagatccacaagatcaccaaaaatgatgttgaccggcagaagttccgtgagatgtgtcgtgaactgacgattggcaatatcaggaagatgcgggcatccatgcgcaggatggctttttcaatcgactggagccacgaatacatcaccatgatgccggagtacttcggcaagacccagctctcatttctgcggatgtaccacgcagggcagatataccagtctgaccatccggttaacttctgtccacggtgtgagaccgccatcgcatttgccgaggtcaattacagcgaccgtacaacaaaactcaactacttcaacttctccggactggagatcgcaacatcacggccggaacttctggcagcctgtgtggcagttgccgtccatcctgatgacgaccggtataaagatcgaaaaggcgaacacctgaaagtgcccctgttcggtcatgaggtccccatcatctgtgacgaagcggtagacccgtcctttggttcaggggccgttatgatctgtacctttggtgacaagcaggatgtcatctggtggaaggtccataatctcccgctcagaaaagcaatagacaagaccggtcatatgacccagattgccgggaagtatgaggggatggataccaccagctgccgggaagctattcttgccgatatgaagtccgaagggattctgctccgtcaggaaccactcgagcagcgtgtcgggacctgctggcggtgtaagacacctattgagattctctccgagcatcagtggtttgtcaggatcccgcatgaagccgcattaaaagccgcaaaagaggtcaaatggtaccccgagcatatgtttctccggatggagaactggatctcccagatggagtgggactggtgtatctcacggcagcggatctttgcttcacccatcccggtctggttctgtaaggactgtggtgagatcatcctcccggaggagagcgaactgcccgttgatccgacggttgatgcaccaaagcggccatgcccgaaatgtggcagctcgaactatatccctgagactgatgtccttgatacctggatggactcttccatctcggtgatgcacgtaaccggctgggatggaacacaaaaagtgcctcccctgttccccgcacagattcgtccacagggccatgatatcattcggacttgggcattttacacgatacttcgtgcagtatccctcaccggtggcaaaccttgggagcagatcctggtaaacgggatggttctcggagaagacggatttaagatgagtaagagcaggggcaatgttaccgtccctgaagagattctagagcagtacggtgctgactcactccgtcaatgggctgctcttggtgctgccaccggctcagatatccagtttaactggaatgacgtggtcgcggcaaaccggttccttaccaagatgtggaatatctcacgcttcgccctgatgcagcttgaccgggcccaatacaaggctgatgcacaggtaaccgctctcgcagaccgatggcttttaacaaaattaagccagaccgtccgggatgtatcagaatcccttgaaacctaccagtttgacaaggctctgaaagcgatacgggagtttgcatgggatgttctagcagacaattatatcgagatcgtaaagggcaggctgtactcggattctgatacgcgtgacggggcctgtgttgcaatccggacatccatggatgcaatctgccggatgcttgcaccctttaccccgtattttgcagaagaagtctggtcctttatggaggagagttctgttcatcagcaaccctgggtaacattctcctatgaagatgaagaagcagtcagatctggtgagatcctggttcaggtcatctccgagataagacggtacaagcatgacaaaggccttgccctgaatgcaccgctcggcaatgtgaccgtatataccactcttgcagttgatgatgcaggagatgcaagcactgcatctaattgtacccttacctggaagaccggtatgcctgaactgacacaggtagtcagcggggtgaagtttgacatgggtatcatcggcccgaagctcagagggaaggcaaaagggttcatgcaggcaatcgaggcattaccaaaagagagtcttacatctgttccggccatgattaccgtcgatggagaagagattgcagtgcctgaaggttcagtaattccccagctctcctataccgttgcaggagccagtgtcgacctgatccctgtcagtgacagtctggtaataacgatagagcagtaacccggctgtcagaaattatcaatcaaccttttttcaatcctcaagtggtgggggaaaatcaaatatccttcagtgttaagcatatataccataagtctttcctagcaatgacactgacatcactcactatccggaatttcaaaaaattcgatgatgtgacgatacctcttggagacccggtggtttttatcggcccgaataattcaggaaaaaccacggcccttcaggcacttactctttttgcgatcggcatctccaaaattctcggaaaaaaggagactgacttccctgataaagaaacaccaggaatcaccataaaccgcagggatcttctcgcggttcctgttcctgcagcctcattgctctggcgtgatcttcagatacacagaatggctctgccagagagacagcaggctacaccagacatcccgattgtaattattgttgaaggaattaccaacaataaaccctgggtatgcggtcttgaatttgattatgccaacccggagtctctctattgtcgcccgataaaagacaaaaccgggcatgtatatcctattccaaaagagattaccgggtttgccatagcattccttccgccgatgtcaggtcttgcagcacatgagattaagttagagaccggagccattaacgtaaagataggtgaaggcagaacagcagacgttttgagaaatctttgttatcagataagttcatcaagcgatactgaaccctggatttcggttgtcaatactatcagagaactgtttggagtcaccctgcatcctccggagtacattattgaacggggggaaattactatggtctatgaagagatggggaccggagtcatccttgatatctcatcagcaggcaggggattacatcagacacttctccttcttgcctatgtgtactcacatccaggagccgttctccttctggatgaaccggatgcccatcttgaaatattacgacaacgtcagatctttaatctcctcatccattctgcacgaaaaacaaacagtcagatcattgcagcaagtcattctgaagttgtcctgaatgaagcagcggataaggctgctgtagtggcatttatcgggaaaccccatcttatcgaaaagaaggcaaggcttgaaaagtcatgatagaatgtcttgttgatgcaatccctcccagagcatttcgtgaccggaatgatcggtggtggtctgaaacaaagatgagtgatgatttccttgaaccactctttgccgagttttttaaaaagtcaggacaaaaagtcctgctcagcaagggtggctattatgaaattgcccgatatattagccctgaggagattgaacctgaagtgattgagaaactggacgccatatataaaattgcatccaatttcaaagaatgaaccaggcattacgacttctttttctttctgttcatctcatcaaaccggaaccggatcgcctcacctgcaacttttagtatatgctctggtggcaaagtcccgtccagtataaggaaccgggctgtatcctcttcaaccagctgcatataatactcctgaactttggtcagcactgattcctgctcaaaatgttccccgctcccgcgtttaccggtccgttccagggcgaccggtaccggaacggcaagcaggatagtaagatccggcatgatcgtccacccctgatggacggcccgtaaccaggtacgggggtcaggaataatcccgtcaagggtaacctgctggtagactagtctgctgtcaatataccggtcagatatgaccagacgatcctctgacagggccggccggacgacttcccggagatgggcagcatgatcagcaacaaacaggagagcctcggcgatggggtcggcatgttcccggatggcacgacggactgcctcaccaatccaggtggacccaggttcacaggttatcaccggattcagatcggcaagatatgggccaagagctttgtgaagggttgatttcccactcccgtctataccctctatggtgacgagcagaatgttcccctcctgatatactcaacgggtattttcccggagtgaacggcggttgcaataattgccccgtcaaacccggctttttcaaggagtgccagatcctcttctgatgagacacctcccccccagagcaggggtcctgtatatacttccctgaactgtgataacatttccttatcaagtccccgcccggttccgacccggccaatgtcaaggagtatgaccatctcaaaccggtaccggttgcaggttgagagaaatgtaacaggatctatgttccagggtatcacaagatcatttttaatatcaactgagagaacgccctttgtgaactgagcgagcgtatctgcagcggtctcagtccccacgatcatactgacgccaaaaatatccagcatatcataggggcctttacatccacggtcaaggagtatgcgttcagtccgctctgcaagttcaggaatcaggggatcatgatcccctgttccgcagatccggtccaaatctgcaatatataaaaatcggggtttcatctgttctataaagcggatcggttcagccgtatctgcgtgcaatgatgttaccgggacgtatctgtcccgcataccgctctttccatgaacgatttttccggatttcaaatctgtggcaagatataggtccatattccaaacgtaatcactatttagataccggttccataaaatgtatgcagttgcttgtcagcccagcaacaatagaagaagcaaagaaggcactttcagccgatattgtcgatgtgaaacgtcctgaagaaggatctctcggagcctcttttccctggataatcagggcaataaaagatcttactcataaaccagtcagtgcagccattggagattttgactataagccaggaggagcagcgcttacagcccttggagctgccgcagccggtgcagattatataaagattgggctgatgtttgatggaatcgaagaagctgagatgctgattcattccgttacccgtgcagtgaaagagacctatccggaaaagatggtagttatcgctgcatattcagactgggaacgcctcgaaaccatctcaccatatgatatggcacctctcgctgcaaaagccggtgccgatatctccatggtggacacgggcattaaagatggcaaatcgacttttgaatttatggatgaaaccaggcttgtcgagttcaccaaattaaaccagaaacttgggatcaaaactgcccttgccggttcattaaaatttgaggatattgagattctcaaacggatcaacccagatattatcggggtgcgggggatggtatgcggcggagaccggagagcaatggtgcaggaagaacttgttttaaaggcagtcagtatggttcattaatatgtatatcgaaaaattacaggctgaaacaggacttacctttgatgacatcctgcttgtcccggccgcttcagaggtggaaccggatcaggcagatgtcaccacccgtttttcacggaacatacctttgaatattcctctcgtcagtgcagcaatggataccgtcagtacctcatccatggcagtggctcttgcacgggccggagggattacggttatccaccggaacatgacccctgaacaggaggcagaagaggtcaggaaagtcaagcacgagtctgagataatccagcgcgaagtgctcacggtcaccccggattcactcatcgctgatgttgaccggatgatgacctaccacgggataggtggtgttccggtagtggaagacgggaaagtcatcggcattgtgagcaggcgtgaccttcgggccatggtcagcaggattgggaaccagccggtcaaatccattatgacccatgaaccgattgttgccaaagaagggatctctattgatgatgcctttgacctgatgtactcgaggaaggtagagcggcttcctgttgttgacagtgaggggatcctgaccggaatcatctctatgcaggaactcctggaaaaacgtcagttcccccaggcaatcagggacgataatgggaacctccgggttgcagcagcagtcggaccctttgaccacgcacgggccatgctccttgttgaagcaggggttgatgcaatcgtggtggactgtgcccatggtcataacctcaatgtggtcaggagtgtcagggatatcaagggtagtgttcaggtcgatgtggttgcaggaaacattgcaacaaaacaggcagcagaggcccttgttgattcggttgacggtctgaaggtagggattggtccagggtcaatctgtacgacacgcgtggttgccggtgtcggtgttccccaggttaccgccattgcctcagttgctgaagtggcaaaagatgccgatgttccgatcattgctgacgggggtatcagattttccggagatgtcgcaaaggccatcgccgcgggtgcagactcggttatgatgggcaatctcttcgccggaacggatgaatcgcccggtcagatcgtcactatccagagcaggaaatataaacagtacaggggtatgggatcccttggggtcatgagcaccggggtttcttcagatcggtacttccagaagaaggaaattggaaagacaaagtttgtgcctgaaggtgttgagggggtaacgccctatgtcggaccggtcgccgatgtcatctaccagatgatcggcggtcttaaatcagcgatgggatataccggagcgcggaatattcaggatatgcatgaaaagaccaggtttatcagaattacccaggccgggtatcatgagagccacccgcacaatattaccatcaccgacgaagcgccgaactatagaatataataaatactatttttcactaacatagagttagtgatgttggaacagacagagcttgcccgacttctggatattctgggaaaccggaaccggagaaggatcatagaactccttcgggaaaagccctgttttgtgacggagatctctgagcggctgatgatatcgcccaaagccgtcattgatcacctccagatgctcgaggatgctcgaatcttgggttttcgaaatgatgaccgaagaagaaagtattactaccttgagcatgacatcagtatccaggtacatctggatgtccagagccatgatctggtcccgatggtactctccggtgaacagcggctcctcatctccctgcaaaaactgaggcagatgatccaggaacgtgatgaacttgccaggaagttggaggagatggagcgggagatcgatcaccagatcagcgaggtcctccatgaagggaaacgggccggaagcggagaagaaagcatgctggtatcggttgctctcgcacatggggcaacgaatgctgaagagatacgggacctgaccgaccttcctccagagacggttgacagtaccctccgtcagctgatggacgaaggtatcgtatgcaggaaaggaacaggattagaactccgaggtatatatgccgaataatccctacgatgacctgctcaaaaacctggtaaaactgcttgagcagatcacatcattagaacagaatatgcgaaagatgcagaacggagtaccggcaaaaccaggtattatcggatgcgcaatcataaccggagggctgaatcaccgggatcccgggatggcagattccaggcagaatcaaaaacccggacttgcctatgagatggtcgatgcaggaatgacagcctacctgaccattcagctccccccacacctctccattgaaccatgtgttgagtttaccgagcgcaggtgtaatatcagcacgcagggcatgtccggaagcattgatctccagtttcccatcattccggagacctcttcatggacgtaccataacggcgtgctggatgtcgtgcttgaaaaacgcccggaagagccgacaggaatagatcctgaatttgttgccggggctgaatactcctgaacatctcatcttttttgatctcatttcaattggtatatcatcaccgctgaccgatactcttttatgatcgtcgtgataggtggcggaccggcggggcggtacgcggccatgcggcttgccagagcaggaaaaaaggtacaattgattgaaaaacgatcagcgggggtcggagggcagtgtctgcatcaggggtgcatgatcatctgtgctttaaatgatgtggcacgattcatgcagcaggcacgggtatttcagaagtatggatttcttgggtcagctgaagggttttcgtatccggttctgatccggaagatgcaggagatcattaaaattatcgccggcgttcttgaggaggagacgatacatgccggagttgagatcatccggggttctgcagagatccagggaagaacgctccttatcaacggggttgagactccatgtgaagcggtcattgttgcatcaggagctcacccacgaattccggagatatcgggctgctgccttccgggtgtctataccgcccataccattctttcaatgcccagccttccaaaacggatggtcatcatcggcagtggggtcattgcagctgagtttgcctatatattcagctcctttggaacagaggtgactatccttgccagaagttcattacttcgggcgtttcctgagcaattgataaaggaagccaggaaggatctctcccaggttaccattgaagagcaggtcaccattgcaggaatcaccggacaggagagtgtcaccggtgttatcattcgggagaatgatggaatgagggagattgccgccgatgcggtgctgcttgctgccggtatgatcccgaataccgattttatatcagatattgcctgtggtcctgacggtgcccttctggtcaatgatcgcatggagacgtctgtcccaggtatctatgccgccggggatgtcacgggaaccggctatctgacaccaattgcacggcaccagggacgaaaagctgctgatgctatccttaaaaacccatttgaacctgacccggttgcaatccctcaggctatcaaactgaaacatgatgtggcatattgcagacgaccgggtgaagtccgaaaaggacttactattcctggaccagcaggcccgggcactttctgggaagtgacaaatcatcataccggttctgcaaccatcgaatttgacgagaacggacatttaaccggccttgcggaggcctcccctgtagcttctgttgccatggcgtatcttggatggatgatgaatagtgatatcagaattgatgaatttgaccggtttatcgaggttcatccatctcctgacggtataccctggctgctgaaatatctgaacggaaaaaaaagtgataaccagaaaggttcatagagagttttgttccatttcaatggctggttcctgaaaaatcaattttatgacaagaatttataaaatttattactgatgatatatcaacaccttttttaagttctaaaaaaatctctcttcatcaggaagagtcaatgataaaaatcattgcggtagatgatgaaccggcatttggtgagatgctcagcatctacatgaaagaattcggtaattttcagattaccgtctatacctctccggaagatgccatagataaaattgttgcaggtgaggcggatgcggtgatcaccgactatctcatggaagagatggacgggatatcatttatcagaaaggccaaatctcttgttcctgatattccctttgttttcctgaccgctcttgatgacaaagatgttatcctgaacgcgaccaacgctggtgcagattttatccagtttaaaagtgaagaaccatcgaggttatttcctgatatcgcccagaaaatcaccaactcagtagagaaatatcgcgcacggagagaatcggagagggggagcaggacgagggagatgctgatgcggacgcaacgggatctcatggccagactttctgaaagctcaacaaccaaccaggctcttgatgcaaccctcaccacagtccgttttctggccggatgtactaccggggcaatccacctcatgaaccagaaaacaaacaagatagaacttgcaatctctcacaatctgccaaatgatctcatcaggcggtttacctttggtgacctgtacaaggtattctatgaaaaaaaagccagatattaccaggatcctggaaagccagagaataccggtcattattcagggggtcaaatcccgattatggctggaacggatgtcatcggtatcctgtccttcattcttgatcatacaaagccgctcagtccggaatttacggataccatggagctcatcacgggtcatctcgggaatacccttgtcaggattcgctcagaagaactggtccgtcagcgtgagaatgaactatccgaactctataaagtgatgcaggaactggtcattgtcattgatatggacggtaccatcctgaacgtaaacccggctaccacgagaattctgcgatattctgaagaggaacttatcggtatgcctattcaggtcctgtatcctccaaagatacgggatgagattatttttcagtttatggacctgaccggttcaggggagacaatccagaatacctatcccctcatcgaccgtcaggggctcgaagttcctgttgagaccagggggagtatcggcacctggggggatcgtcatgtactcttttgtatctccagggatattcgggaacgactggaagcggaacgaaatttgcatgaatattacgagcggatatcggcaatcctggcatcatcgactgcccagatttacatgaagaataatgaactcaggtatcttaccggaaatgagccatttctttcatttgtacagtgtgatgccagggaactagtgggaaaaaccgataaggaattcttttccgtggaggttgcagcacttcgggagaagacagacaaaaaagtccttgcagagaatgttcccctctataaccttgaggaaaatgtgtatggcgaagatgggagcccacattggtttgtctcgtcaaaaattccggtccatgatctgaccggaaaggttaccggacttgtcggtacctcactggatattactgaccttgtgcagaccagacaggaacttgaaagacgagaccgtattctgagtgcagtcagtactgtcgcacaaacccttgtaagaaataatgaatgggaaccgatcattccagagtgccttgaactgctcggacaagcagcaagggttgagcaggtgattcttctcgggatgaatttttatggaagagccgggtttgaggaatattactgtgagtggacgatgtcagatattcgggattatcttcaagttgaaccagatgtatgctcccggataattccctcggtgttctggtacctagaaaaaaaccggttctacctcggtgacagcaaggcgatcaggaacgaattatctcttcctgaagaagagcctgtcccctcatttctccttcttcttccggtattctcttctgaaaccctgtgggggacgcttgcttttgtcacctggagaaaagaacacacaagccccatcgctgagattgaggcactcatcatggcttcagaggtgattggatcagcaataagcaggtttcagaccgaagaactgttccataaaccggtagagcgatcactggtcggtgtgtacctggtgcaggattatcggtttatctatacaaatccccggctatcagaaattcttggatgtaatagggaggatcttgaaaactcgcctctccttcgttacattcatccggaagatgcagatatggtcctgtcacaccaccagcggatcatagaaaacccagatgaaacggatgattatgagttcaggggcattaccgctgatgggaggatgatctggattgaaaatctcatcagcgggataatatacaagggaaaacctgcgataatcggcagtatcatggatattactgtcagaaaacaggccgaggatgatatcagggtgtcactcaaagaaaaggatatcctgcttcgggaggtccatcaccgggtaaagaacaatatgcagattatcgtcagcatgctccggattcagagcagcatggttgatgacccggttgtctctgacgtgctgcaggagagtaagaaccggatcctctcaatggcaatcgttcatgagaaattataccggaccgataacctggtcagcataaacctccttgaatacatcaattcgctcgctcgtacactcatctctgacttttctccggatgaatcactcattactcttgatctcatctgcgatccgtcaattgagatgacaattgatgccggcataccacttggtcttattatgaacgagcttattacgaattcttttaagcatggattttatccagatcaaaaaggtacaatcgggataaccatagtcccggagcaaggcaatctcgagatactttatcgcgataccggcagaggactgccccccgggtttgacatggagacgagtgatacccttggaatgcagatcatttctaatctcatcttccagtcaagcggagagatctcattctccaccgacaatggtacggttgtgaatatgaaaatacccattcaagaaggatttataatcaggggtgaagagcatgccacaagggagtaagatcctgatcgttgaagatgaaatgctcatttccatggagattaagcagaaactccgggcaatggggtacgaagtcgttggtcaggcaataaccggagagtctgcaatccagaaagcaggagagacaaagccagacctgattctgatggatatcaggctgaaaggtgagatggatgggattgctgctgcgaagcgtatcatggagctctatgatcttccgatcatcttcctgaccgctcattcagataaagcaacgcttgagcgggcaattgccgtatccccatcaggatatctgctcaaaccgtttaaagaacgggaactgatgacaaatatcgagatgagcctccataaacaccggataaaacaaaaagtcagggaagaggtgcatcctgaggcattatccgaactgggtaaaaagattgaagcaattcccctgccggttgttctgctctctggaaccggaactatcagggagataaaccaggttgctgcaacccttgccgggtttcaaaggcaggaacttttgggacggccggtgtatgcattcttcggattactaggtggaggtgatgcagttcaggatgggagtggcgtggagatgatccttcctgaccaggtatctctgaagcgaaaagacggatctatggtcccggtgaccctgaccgggggatttgtctttcatgaaggtaaccagccaccatcatatctgatccttatcgagagtgcagagagtgctgcgactgcatcctctcatatcggacctgagatgataaggcatctgatggcagtcaccacggctctccgacttccggcatttgttatcgataaaagtctgatgctggccgggtataatccattatttgcagaacttgcacgaaaggctgggatcagtcagtacatgctgaacagaccgctctatgagacgccgaaattctcattctttggagacatgcaggatcttcaggagttattcaggtcaggagatgttgagcggcggatacgaaagtacacctttgacgaaacggtaaagttcatcgagtttacgaggatacctctcaaaaaggaaggaatcccgacgcatattgccacgatcatggcagatgtcaccgcagaacgtcatgccgtctttgaagctgaacgaatcaaaaaagagtattcggaactgtattcaacccttgagaagatcagggagctttcagcggagatcagaacccctatccaggatatgctgctgaaaatgtctgaaggaaaacctcttgagagtggatatgcacgtgagatgacagatcaggtgtcagatcttatgtcacggtttgataccgcatggattcggtatgcagaactaaaagatcagataacaaaaaagtaataaaaattcagggacagttttccattattttatgaatcttctgatattcagtggcgatcatctctttcagaccatcaagactgtgaaggatctccaggttatcatctgcctcatttttcagtaactgctcctgttttgataggttatcacggagaaacaggagaatattattctttttaattgcatccctgcatgccgcagccttttccggaggcagaccggaggatatggcttttgaataccgctcttcactctcttcgatgacttccctgatatcatcaattgctttgagaagcatggtccgctcgagtggtttcatgacaaacccttcgatcatcataccatatttcactgcttcctgaggggtcagaactttaccggtcaggatgatcacaggaatgtcagcgacatcaggggtacttcggatcatctcaaggacatcccatccggataccggttccatcataatatccagtaaaataatatccggccgggccgtccggattgcttcgattgcatcctttgcatgggtttctatcctggtttcatgccccccacgggtcagaagcttctgatagaggatgcaaagtttttcattgtcatcaatgagcaatatatgcatatatcctatgtgatatatagaattgtcaaggacgataaatttatgcatcgttcatgaggaataaccatatattttgaaactttgattatttatattaattttagaaattttccggatatgagtgaattgagcgcttattactaccaattggaactaagataggttcttatacaacccaccctaatatcagagataaaaatccctgatttcagaagtataaatttctatattacccatgaatacgaaaataccttcacaaatctatcaggattatctcaccgcccttctgagcggtgatcgaacgtcatgtaccatcatagtcagggatctccagtcatctgggttagatatcagggatttgtttatcaatctttttcagcgttcactctatgacctgggagaactctgggagcatcaccggatttccgtggctgttgagcacctggcatcttcaataacggagcggctcatcagcatggtggaaactgacaccttttctaccccgcacggggataattcagtgattattgcctgtatcgccgatgagtatcatcagatcggggccaggatggtgtcagacatctttgaacttcatggatggaacacccacttcctcggagcaaacaccccggtcaaggatcttatcgccatgatacacaagagaaaacctgaccttattgtggtatcggtgagcgtatattttaatattccaaacctcctttcagctctgacagaacttcgaacctcatttccaaaaatcccgatacttgctggaggacaggcattcagatggggaggggtgcagcttctgtccaggtatgaaaatatcagatatatctccgatattattgaactggaacaggttattggggcgtatgacaataaagaacctacatcttcatgatgacccctggtttgttgagaaaacccttgactatatcctgcataagtcacaggtttttcttctcattcttagtccttcaggggagatcagatatgcaaatacctatgccaggactcttttaacccaggatcctaccggagttcatatacgtgaaattctgctctccgggtcatggaacgattcattacttgctgactggaccagcggcgatgtcacccctatcatgaatatcaggactcatgatgatcttccccggacattgtatatcaccgtatacccgactgatgccggatatctcatcttcggacatagtgacagtgaagagctgcaccggttatcaaaggaagtcctgggactgaacagggaacttggaatcctgaccagagagttgcaggtcagaaacagggaactggccgaattaaaccggatgaaaaaccagtttctgggtatggctgcacatgatcttcgaagtcctttaagtctcattctcaattatactgaatttctgatggaagatcttcaggacaatctgtcagatgagcaccgggaatttctgcagaccatcatcacatctgcccttgatatgaaacaggttattgcagatttcctcgatgtcagtatcatcgaatcagggcatcttatgttaaatccggggcccatatcatttgaaacccttatgcaggaactgcttcgaaaaaccgggctttccgctgagcggcgatcaattcggatcacctggaagacggagggggagatgcctactctttatgttgatgtcggaaaaatcggacaggtcctggcaaatcttgttcataatgcaatcgagtattcccctgatcagggggagattgagattctgggacaacgcaccgatacagggatcgtgtttatggtacaggatcatggatccggcatatccaaagagaaacaggataagttgttctctgaattttcagggacatcaatgaagaaaaagaacggagaacgaagtatcgggcttggacttattatatcgaggaagattgttgaagctcatggcgggagcatgtttgttgagagtacaccggatgttggatccaaattcggttttattctccctgattcagtcatatggtctgaaaacaaggatatccagatccaacagccggactcagggaaggtataaatctatacaagcagatgatgaagataggacagacggaggggattatttgtgaacgaagaaaaactcattatttcggcacaggagttaaagcagccatcagaagaggcaacgaagatattctatgataaaattgataccattgctgaagaactcaaccggataatgctcggaagaccggatattgaccggctgatcgggctgaaaaatagggagatgatggagaataactccagaaactatctccggtttatgggagctatctttcatagttatgacccgattgttcttgtgcagacatcactctgggcctttcgggcgtatcgtgctcatgggttctatattgaatactggcctgccaacctggacacaaccgttcagatattaaaaaaagaactcccggaaaaggtctacaaggagatatacccgttctttgaatggcttattgtgaatattcctgcctttgtaatcatcaccgataccatgctgaaggaagagtcgaaaccatacgaatacatatgaacgggatcagaagaagtacataataccaattcaattcacataatccgatatcctccctgtgggacatgcagaacaaattttgcacctttccctttctctccttcttcggttatctcaattccagtaagcagcagaatttccctgattaaaaagaggccgaatccatggatcttgctatacgatggttcaaatatccgggcctttgcttcgacactcacccctgctccgtcatcttcatagattatccggcacccgttcccgatctgctgataataaagatatatggtggataccgtctttccatgccgaattgaattgtccataaggtttgcaaagactttcggaagcattagatctgcaaatatctcaagagaacccagggagtcctctaccttcagggatgagaaacgaggatcttcttttcgaatattcctgacaatagacgagaccgactgccaggagggtttttgtgatcccatctgttcataactacgggtaaacccgatcttcgcattgattgcatcgattgattcgcgaagatagccaacaatttcattcgtttcaggagtgtcaggaattgcccctttcaggagatcaatggaggcataggcgagggagagatcgttattgatgtcatgcctggtgacctgggtgaggagttgtaatttcttattcgcccggataagagcatcttcagatatcttcagagcggtaatatcagagactacagtcgctaattgatctggatctaccatgaagactgaaaccgtgtaatatttcatttctggccgatatagggcgttaaaacggactgttttcccggatgctgccactgtccggtagtatttgagatgggggggagaggctgcatttccatacatatcagttccggtctttcctataatgtcttcaggagtcagtcccatcattgctgcatatcgaaagtttacatcaataaaccgatagtctgtgatatcattctcatgacgtatgagttcacataccgcaacaccttcatccatgttctcaaacaaagcccggtacttcttctcgctttttgagaggtttcgaaacaggatctcaaatggtctttgtaacccggtaaccacaatggcctgataaatcagggcaaatgccactattttaaaaatatgacccaggtaattggccggcccatacacacttacatatgatgtgaatgcaagctctgaaaagatagtggcgatgagggccccgtacaggaggaggaggacatcacgtgagaagtatgccttcttttgagagagaagagccatcgctcccaggaggatcaggcagattacatattcactcacgattttaaacgccgtaagcccggagccttctatataacaggcaggaaaatatccgctgaatatcagagtgatgagtgttgctgttacgagaagaaacccccagaaggtaataccagcattcacccgacgggcgatgaaaaaaggggctattagaaaagttaccgcctcaagatatcgtgctgcaatccagagctgggtcggcaggttggcatcatatccgataaagatattcatccccttatatgcgagggtatgcagaaggtcgatagaggctgttgcacaaacacaaaaaaagcttaatataaattattaaagcttaattatatatattattaagatcaatatattatatgtctcatcgctataacatgattagaggatatggtaatgaacaacaatttttactccctgtcaatgcgatggactggctatctgaaaatgatattacttatggcatattagaaattctttcgattctcgatattagtccatttattaataaatatcgtgacgatggtcgcggttctgccttttttgatcctcgttcaatgcttggaataataatttattcaatgattcgtggagaaaaatctagcagaaaaattgagatgtgctgccattatgatattggatatcggatcgtcgccaataatcttacacctgaccatacaacgatctatcgtttcaagaagaataattcaaaagaaatcaaatccctttttaaacaattatctcaaattatcgtagaatccgggatagcaagaatcggtgtcctagccctcgatggatcaaaatttggctgtaatgcctctttatcagccaataaaaaattaaaataccttgaagcagagctaggtcggctttttgatgaatcacaggaaattgatgagttagaaaacgatgatataaatattcaggatatggagattaaccgactacctgagcatctttcaacaaaagaaaaacgaaaggaagttcttaatcgggctaaagagaaattaattgaacgacatgatatcgaatctaaaaaacaagaagaaaagattctggaccgcgaaaaagaagaattagaatcgggtaaaaagaaacgaggtagaaagcctttagagcctaaaaaagagccatcttcagattcaaaagtaaatctcactgatcctgaaagtcagataatgtcaaccaccaatggctggattcaagggtataatgggcagattatcgtttctgaaaatcaatttatcctcgctgcaatgatatcagatgagcaaaacgataaaaaattattaatacctatgctaaatgaactcgaagacctttttacgggtattcatccatcaatttcgcctaatatactactatctgatgcaggttatttctcatacccgaattctttagcagaattggattatggcattcaactcatcatccctccttctaaagaaagaaaaattccagaatattcagataatgatgggtatatctcacgaatggaaatgatatgtcgggcgatttgtatgggagaaataatcacatttccggaattgcaaagtatcgggacgtttgtttggcaatcttttatgaacagagagaaacaagcaacaactcaggaaatttgtaaacgagttatggaagtacgtgtgaaatcccccactggtagagagttatatcgaaaacgaaaatacatggtcgaaccagtttttggtaatatgaaacataatatgaggtttaggagtttctctcaaaaagggaaagagaattgcgagggagaattctttttagctgcattagtgcataatataaaaaaacttatcagatttgagggtatagttaaaattaaagaatttgctacgaatattataaaaccgtcaagaggttcaggtttttcctatatttttgcaaacacagtatgtaaagtgggaattgatacatgcaggttcatacatcaattagtctattttggttgatagcttaaggggtagagatcgatcatttgtgatcctgcatgatattgatcattggtgcaacaccctcgatagaaccgataaaaaagaatgcgatgccgataaaaattaaaaatccattgtcaattttatcccggctgttccaggtgattacaaaaattactcctgcgatgatgatactgaagaactctgcaaaggtatgaaacaggagataactatacccgatggtcagggatattccgatgatgaaaatcacgaggatgagaataaatcgtatggatgaagatttagtcaatttcatggtgcttctttaaaaaattacggattttcgatgatgcaatatatccattatcgagttgatcaataattttgtcaatttcgtggatatagggcattatatccggtaattgttcactctcattgatatcaagaattgcaacaatgatagagaggggatttctgatctgatcgtttaaaagggcaaatttttccaggttatcctcaatctgccggtatgcatcatgaacgacccgtttcatcacgatgctttcagagatatctcgcagatttatgacaactcccgtgcagccatgatctggttcttccaatggagagatcaccccgtcaatgtagactctggaaccggagggttttctcatatataatggataatcaatctctgaaagcggcgtgcttttctgaacatgatagggaagatgaaccggaaggttatcagaggaccggtataatgtcagtatttcagagagagggtggccgatgagatcgcaatgagttccaaggattgtgcaggccgcctgattcatcagccgaatctccccggttgagttaatggcgattattccttctcccaccgactcaaggacggttttaagccattggcggttttcatgaactaatttttcagactcatgcttgtatatggcaacctcgagggcgttagtaacatcatgttcagaaaagggtttggttataaaaccagatagtctggtcgatgttgcccgtctgattgtccggatatccgaatacgcagtcagaaagatgatggggatactctggttcctattgatctgttctgcagcagtgatgccatccatatctccggctaaccgtatatccatgaggatgacatcagggtttttctccctggagatggagattgcctcttccccggtctttgccactccggccagatcatacccatgggcctcgatgatctttatgaggtcaagggcctcaattctgttatcttcgactatgagaatacgatatggtgacatccacaagccctcggtatcgtaatggaatccctgccatcatgatcatgaaaggagtaaaaagtatattggtgtcaccatagataagtccatggatatcaggtacatatttagtaaaactactttattttaaggaaatttcctgcgattattcagggtttactgtttagaatttgaatgactttttttgctttatatcgagtcttgaaccaaagaatcattcaatacttcattcaaaggaaatggattatcataaccacaatttgttcttaattgacctaaacgcgtcaaattggcttttattattggatctaccatatcacttttcatttttacattttgatgatctattcccgttctacacagtatatagatattctttcgcttaagaatagttatcaaattcagtgcgacaagaagcagtaaatcggattgcgaacccggtttaaaatcggtaacgccacccaatccattctgggcgtccctacctgcacgtgcgtgtttagcaataaacgggtgcgaagctgcaggaacaacgtggtgattcccatagtctctttgggataagctgccagggaaaggtatcatggacaaacaaacgttgaaccgctgcaggatcgttaattatatcaggaggaaagagatttgcccctgtccccactgagggagaatcacggtatcagtagcttgaattatgctggtacgaatggacgaagctgattccggtctatgggcgggtcctaaaataccacaattatccgatttattgaacttggaaaacccaatacgctcctaaaaaaaaaaaaaaaaaaaaaaaaaaaatttttttttaggtaagaaccttgtgagaggaaccacatgcgtagtgggagtaggaggctgcaaaacgcgaatgcccggctgtaatggctgtggataggggttcaaactttgccctgacctgaaagggtgccgacgtgcagctggtttttcacggcgaacaggatggtttcaatgaacgggataagttcaattacgcataaaagcgaggacatctcggacagaaaacttgcaaaacaatggaagaaatttccatttgctaaagcaagagattatgtaaagcgacttcagacacgtatcgcaaaagcagtgaagaacggccaatatcgacttgcaagacgactccagtatctgcttacacattcgttttatgcaaaaatgttggcagtacaacgagtaaccaaaaacagaggtaaaagaagtgcaggagtagatggggaaaaatggaccacccctgaacagaaaatgaaagcagcattaacgctttcggacaagggctatcgggcaaaacctctccggagaatctacatccctaaaccgcaatcgagtaaaatgcgacctctttcgattccaaccatgtatgaccgtgctatgcaagctttgtatgcaatggctcttatgccttgggctgagaccacagcagacaagacatcattcggattccgaatgaagcgaaatgcacaggatgctgcttcatacacttttcagtgcttaagcagaaagacttcaggtcaatggatattagaaggtgatatccgcgggtgcttcgataatttcgcacaccaatggatgcttgataacatccctcttgaccaaagaatccttaaccaattcctgaaagccggttatatttatgatggaatactctaccgtaacaagtcaggtacgccccaaggcggcttaatttcccccttattggctaacatggctcttgacggcatggaaagaatgttgaaagaacactttcccggaaataaggttcatctcatacggtttgcagatgattttctcgtaacggcagactcacaggaaacggcactccagtgcaaggaactcatcactgaatttcttcatgaacgagggcttgaactctctgaggaaaagaccaaaatcgttcatatcaacgaggggttcgatttcctgggctggaatttcagaaaattcaaaggcaaattcctgatacaaccttcgaagaaagctattgccgcaatcattgataaagtaagggtaatcattaagtcggcgaaggcctggaaacaggaagaccttatcaaagccctaaatcccgtaattaagggatgggcaatgtatcaccggacggcttctgcaagtatgacctttgggaaacttgactgggttgtccgaaatatgttgtggagatgggcaaagcgccgtcataataataaagggaagagatggattgccagaaaatactggcacccaacacttaccagaaaacaggtctttagaacctctactcttactctcgaaaacttctccaacaccaaaattcaataccgaaaattcataaaactggatgcaaatccgtttattgataccgagtattttgaaaacaggccaggagttttcctctcaaagcaaagatcgatacggatgttccttcactacgcccataaaagcgggtagtgaaaaacttgagcggattgcggtgaaaatcgcacggtccgttcttggaaggctgggttagggtaacctaacctggctattcgacatagactcatcattgaaattgagcatgaaaagcagtttctgtcatggaacatctatctgaaggatgggggatacggaaaaccagtaggttaacaggtgtgagtttagggacggtggctagacttttaaatcaccaccaaggagtaatcccctatgctctgaagattcaccaccggatcccataatccctgccaggtgatcctgaaggtccagaattatccgtggatataggaccattccaggcaaagggaattaggccctttcggtcaccgaccaggcttacctctctcccccatcacccaaaacactgctgccttcttctttggccagtcccggatcatccctctcagctgcctggtgagcacgacatactctctcccatcactcccggagatctgtatccgattccctgatgatgagcacataagaccaggaacaatcatcccattcagaaccaggatcagatcaccggttgggatgacctgaaccaccccgtacccgtctcgtataactgcgaccatccccttctccccaggaatgagacgaccaaccttctcattcctgaacgatggctattcatgattaccccaaagttttctttttgtgaatgcaaacaatactattatttatatgaaaactattcacgtcccaattcttatagaaacagacgaagatggtatcttcattgtttcatgcccccaattcaaaggatgccatacttatgggaaaactatcgatgaggcattagcgaggataaaagaagtaattgaactatgctctgaagatacccccttggatactctgaatacctttgtaggatttcgtgaggtcgaaattgtccagggtgcgtaatgcttccaataattaaagggaaaacactcatttcatttctcgagtctcttaattttaccataatcaggcaacgtggatcacatgtacggatgaagtcagaagatggaagatacactaccattccagttcatagtggtgaggctatacccaaaggcctattacgaaaaattattcgggatgatcttgaaatgacacttgaggaattcaccctggcctataatgaatatatgggaaggatacagtaatccatatctcctttcattttttattgaatatattaccactatttccctctctcccccccatctcccaaaaaaccgctgccttcttctttggccagtcccggatcatccctctcacctgcttaaccagaacaaaatatgatctcccatcagtgcctgtaatcaccatcatcttccctgaattattcactgatagcatggggaccgaaagcccgttcagcaccagaataacatctccagtggggatgataccaatcaccccaaccccatcccggatgacctctatcatcccgtcttcacccggataaagccgaccgactttttcataccgaacagccggtgcatcccgttcagatgtaacgacaaagggcatcagataacccctctgccaagaagcatctcccgttcataacaggtctgacagattccggtctttgtctcataatcccaccaggctattccctggagtttgcagacatgacacctgccataatcagtcgttgtccgttgcatccgggttatattcaggactccgggtaatgtccggacagattcagactcctgcataagagtccgggaattacatgccttactgagcgtacacccatccgtgtgatgcctcaatgatacgttcgggggcttgcagatggaacagggctctttcgtatcatccaaagatatcgaatgatcgccatcatgatcaggaggatacgtaccgatctttgcattctttccattctttgcatcagtttgcaccactggatgcaaagatatatccggcatttgagattgctttgaatgatttcggtgtacatctgaagatatatgatcctggtttgcagcagatgtgagatcacggtgtgaatccgtgtttgtaccgatggcagaatcgtgggctccgggtaagactgccgtgctgcaaacataactattctgagtagcagacggagtattttcttctaaatccgtcgaattgtcatttgttaatgtgcagcagctgctgcaaggatggtgcaaagaatgcaaacttcccttattgtcccctgaattatcgtcagaatcatcatccagactatttgagatttccaaatcagaaatccagcacccatctgtcccagaccaggtatcatagaccagagcatcccagagatatgcctttgcacgccttttcacattgaaaccctcatgttctcctgatatcgtccggtcagtaaatgagagagcaggacatttttcaaggaggcctgaatggattacccctctgttactatacccatgcaatgtccggtagatggtattgtacgacaatccgcaaaaccgctgaagttgtggtatcgtaacctcttcacggtcaagattccggattgcggtaatgagctctgcctcctttctggtaagtttcgtcgtctgacctccggactcaccacagagcttgatatagagagaacgtgcacgggagaaatcctccatagtcgcggtcacacaggtgactcctccgatctcctgcctttcacgctggaactggttcattatggtatgggtccggataagatctatcagcatatccgggtttcttctgttcgaggcagacgtgaaccgaatctgttcagaatatggaatgacaacccagaccggtgagaagagaatatcccacatctccctgcagactttgatctccggatggagagtcgcctccggaagagggagctcccgtgctgaacgaagtgtccgggataaaacttttagatcctgctgctcactgtcatctatccaggtggtaagcatccggttccagatctggtcatctcctgctccttctacctttgaaatccaccatacacaccgttccggaatcacacaagtctgacttttgcggtccttgttcacggtcagataccggaatggcttttgaaaactactggtgactcctttcaaaatctcctgcatctgatctgaaaggccggtatcgtcaagggtgattaccataccgggcaggagggtttctgcataaaaaagggctttgtcactgattcgctgaccgatccgatttatttcaggcacctgggccagcatcacgtcaaatgcatcggtctttccttttcctgatgttccggttaccaaaacatgcagtcctttcgatttcgggtttgcaatcgcacgtgatgcaagagagagggccagacattctgcaactacttcatccccttcatgatccagggcgaaggtctggagggaatacaagaggggatcttcggaattcagtatccggagtgcttcctgccttggatctaaatcagaggcagatgcagaagcaggatggagagactctttttctctggcaggagaaggagaacagtcaggagagtcggtctgttcctgaacaactccctcatgaccggaatcataccggtatccatcccgttccacttagcttttgcccgattccgattgctctgttttattctggcttcataatcctgttttggacggggccttcgaatcgttcccgaagttctgaccatcgctgggttccgccaccacaggagttgtgatgacatccggcaaagattccgccacttgcaaactggatggcataggctccatcggtgtgtgcggtagagaacggacatgcatcaaagaggaatagccgtccgccggcaaacggtttctcccggtaggagagatggtggtctgaaagccatgctcctagatctgctaccgatgaccgggtactgccctttggctctgttttcttctccggttgttcacagagaagcgatgcaaggctggtcaggagtgatggtgagacgatctccagggtatccggcacatgcagaagagatgaccggcggtgacgccggcccggtcaatccatgagattatgccggcatccagttatattggtctcttagacccggacattccgatccagattccctttaatatcaccccgcacgggaatgaaccggtgcagttcattgtgcaatacaaaaacgggatcaatctgcataactcatcggtgagcgtgcctatctctaccgggacaagtaaaaaacaggctgacctctttgtttcaaatattgagatcacaccagggatggagcatgtaatcgtcaagggggatgtgacaaatgcaggtcttgaggctgcaaacgccgtggtcgtaacagtgcaggatccggctcaggctgtctacccgtacaagcaatatggggtaggcctcttaaaaccatcagatttcgcaagttttcaggtgacattcaaaccctcaccgaatgcaaccacagaaaacctcctcacctcctttaaggatgcagacgggaggataatcagcacagagacaccgcttgatcttaccggaattaatgccttttcagatttggatatgatggatcccgctctaattgggccagagccatctggtcttctcccggctggaacagagataattgccggggtggttggagggattgtgattggtatcggactgatgtatgtgtacatgcgacgaaaaaaccgaaccggccagaaaaataccctgaacagaaaaaaccaggttcagaactctgaatcttcgatgacgctggaggactcagataatgggggagatattgaggggggctctgcatatgtccggggaatggcatattacaggcagggtgattttaagaaggccgctgaggagtttttcgcggtcactgaagaggatccatccaatgacaaggcatggaatgcatatgggatctgccttactaaactgtcagagtttgcaagtgctgagagatgttatgagaatgccttaaagattcatccggagaatatgagttatcagaagaaccgtgatataaaccggaaaaagatgaaataatcaagtctgtaaccctcatcttttttaatttcgcataccttttctgtcgccctttgctgatgcaattcctccatggtttcatataatcgagtaccgtatcctgccagaacattgtagaacctataatccatttcatcatgatggtcagaaaagcgggaagaatcatttatccaattacaggggctctctgtattaccatcaaagaaaagtttaaattgcacacatgtgcaatatgaataacatgtccagtgttcagagttataaacggatcccgatcacacctaaaacctgggaaaaactctcaatccttaaaaaaccgggtgaaacctttgatcatctcattactgatttaattgaagaacgagaaaaactggatatcataagacatgttacaaaagtgtcagaacagggagaatttctttcattggatgaggccgaggaagcctggaaagaatgaaagttgaggttgaaataaaagcgtgtaattttgtgaaagaattacccattaaaggtcgtcgtattattcttaaacaattacgcaggctggaagaaccatttctagtatcagaaattgaaaaaattggtcatgatgtataccgtctgcatattggtcgaacctatactgtattctttatgatctatccggaaggtgatcttgtcagagtgacagatatattgcccatcaaaacagcacataaacgatacaaccggtttgcataaagaatactcatgtttttaagaaacaagagaaggttctatcgcccatcaggtaaaatagcactgtattcaacagagacaatccctcatagattacccagttctcagagtaactcctgacttgaaatggcagaaagccggtcaggcatatacctctggtatgaacattccccaagcacggaagcagtctccttatgaattcctttagtcaaatcctttatgatagtcactttcgcccctcgtgccagccatccttccattgcaaacctgttgcagaaatcagaagccactccaaagagcgttacctcgatattggccagatcatgctccggtgcgatggaatgaagaaaggaatcacgggggattacctgccctggatgacggggatcatcaacaaaatgaaataacgattcatatgcaatcttccggtcaggatttgtgaaggatattgcctgccctttccgctcaccccacatggtaaactggttcttcatcagataccaggtatcaggcagaccggagacatcaagagataattcccaatcgtcggtctggtattcacagtgaataggaaattctttcgcttcctcgctttcttcatactcttcggaaaagtgagtatccagaatgacaaaggtatagtcaaatgctgatttaggaattttttccaggaattcctgtgcaggtccgaggatgtcttctgctccgctcacatagaggtttccgttttttatcgtaaaccccttctgcatatcaccgatctgcaatatccggacaggttttttgatactcatggtttcacaaatcaggaaaatacttcgttcgggttttctattgaaggaaatggttttgttgtattcgtatatacaagccccggaatatcatgcaggatatctgtccggtatacccgaggaccatactgatacccggtcatattataccaccattcaggatatcctgaaagagtctcatttttagagaccggatcccataccataccgtttgagaacctcacgatcaattcgccggagagaggtcgagatccggagcgatccgattatatatgctccatatccgccccaatgtatgatagggatgagtacattctccggcagaatatgccttgctgaaatgaaacggaccatcgtttggaatccaccagacttccggttaagcacctctttttctgatggcttttaaagactgccgtggattttgacaaagcaccaaaaaattaatttctaaaactatgaatcggtgccggaatccgtccaccccggttgataaacttgctgcaatcgaaggtattcacctgctggaccggagcatgacctaaaagaccaccaaactccaccatgtcaccaacatccttgccgataaccggaatgagccgcactgcagtcgttttctgattgatcatcccgatggccgcttcatctgcaataatccctgatatggtagatgcaggagtgcttcccggaattgctatcatatctagaccgactgaacagacacaggtcattgcctcaagtttctcaatagtgagagatccacgtatcacggcatctatcattccctggtcctcgctcaccggaataaacgcaccgctgagcccaccgacaaaggaacttgccatcaccccgcctttcttcacctggtcattgagcagggcaagagcagcggttgttcccggtgcaccaaccgattcaagtcccatctcttcaaggatctctgcaacactgtcccccaccgatggggtcggggcaagtgacaggtcgacaatgccaaacggtaccccaagacgctctgatgcaacctgagctacaagttgtccgacccgggttaccttaaatgctgttttcttgaccgtctcacataggacttcgaaatcttttcccctgacactctcaagagcatgcttgacaacccccgggccactgactcccacatgaatgacggcatcagcctctgatatgccatgaaatgccccggccatgaagggattgtcatcaggagcattgcagaagacaaccagttttgcacatcccagggagttttgttcctgtgttgcctctgcggtctctttaataatctgtcccatgagccggacagcatccatgttgatcccggtctttgttgaaccaatattcaccgaactgcagacccgttcagttgccgagagggcatggggaatggacctgataagaagttcgtccgtccaggtcattccctttgatacgatggccgaataccccccgatgaaattgacacccatatctgctgctgctttatcgagtgtttgtgcaatagacacgaaatcctctggagattgacaggcagatccggcgatgagtgcaatgggggttactgatattcttttattgacgatgggaatcccgtattcaagttctatctctctcccggtggagaccaggtttctggcaaggcgggttatctttgcatatatcttctggtttaaggtatcgagggaagcatcacagcagtcaagaaggctgatgccaagggttatcgtccggacatcaagcttctcctgctcgatcatattgtttgtctcatttacctcaaggatatttatcatggaatttcctgttaaattcgatgcatctttgtaaaaatatcttcacgctggcacttgatcttcactccgatctcgtcaccgagtacatcaagatcagttaccatatctgagaagggtttggaggagcgttcggtgtcgacgatcatcatcatgttaaagtacccctggacaattgtctgagagatatcctcaacgttaatctggttatttgccagataggtgcatacttttgcgataattccgacggcatcctttccgaccaccgtgataattgttttactcataatccaatcagacttatacatttggttttcataggggattatagttgtagcaccgagaaggtctcaaaaaaaagatgaatattacaccacaaagagggaaatacatctgattttttagatctggatgagaactgtttaaaaaaagggattgtccccggcatacatacccggattattcactgacgattttcagttcatcaggaaatgccttgatatcccggtaataggctacaggtgtccagataggcccgtcagatctctctattaccttatagaaaacataaaagctatttgactgatcctgggcttcattcattacatattgttcaccaatacccaacgctccatagggattattaataatattccacagttcttctgagggggcatccggacgtgtcattgcataagcattcattgctatccaggcagcatcataactggatatctcattccatcctgcatttccttttattgcccgtgaaagatattcaacggcaacatgcctcatcggaatgaagatctgatctgcagcactgtcaaagttgacacaggtcagatttgtctgtatagccacagatactgcactttccgcctctaataaattcctgctttgcgacacaccgtcaccactataccatgcaacagacgtgagtggcccttcctttactgcttcaagcattgagatgatctcatcagtgccaatcactaccaccgcagtaccctcatacccggcagtctcaactgctctggcggcctcatccagaacagaggtaaaatcagtctcattttttgcataactgaaactatctatacttccggtaacggtttcagagagagcatgtgaaaagtcctggccatatatgtcatcgcgatacagaaccaccaggtgctttttaccttgttcctccatgagtctgaccatggcttttaccagatgagaatcatccggactcagacgaaaaatgaaatcatctgaatctgagagggagatggcagtgctccgggttccaagaagtataatgttattttctcgtgcatattcctgaaccgcggataattcatcactaattccaccaaatataatgagatttattccgttctcgtgcagggccctgacctgctcaagtgcgactgccgcatcactttctgaatcccggatatcacttgaaaaacgaatgttcagaccaagtgcctttgaatagtaggtatttgcctgttcaatagcaagttcaatcgctttttttgcaccggtacctatctctgcattgactccggtaataggcaaaacagcacctatgacgatatcaccaggttcatgggtcagtttaccatctgcatcggtgatgaacattcccgaagtcttgctcctgataaacatcccgtcaagattccagtatatgtcaccattactacccttcgttgcggtaaatcgggcgtacttggctgacttgagatcaccatattcattcaacatagtccactgattgaaaagatttccacctctttcaaataatgcccggagattggacttataagtatcaaagtctgcatggggatcaagacgatatgtctcggctatgaaccataatgcatcccatatcggcagggcatcgggagatggagcatgtcccagttcaccactcataagtcctgttgccagcatcaggggaacaagagtgagtgtttcttcacatgcaaatgcaaccccctcaagtcttgtttttgcggcgaattctgcagcatcattattattcaggatacctgcctcacggatgatactatctcctgaaaaccacttgtaatcacttatcgggctctcaataccggcagttgtaaagattccgatagcatgggactcggttccgatcagaagaattgccccggtgtctttcggtaaacctgctgcagcttcttctatctcctggaccagagtatcatggacggatagttttggatcatacggtatcgaacccactatcctgaatccataggcaggatctgagcctttttcaattatgccggcattcagtcctgaaccatattcatcgtccatgtatacggtcagaacctcagtgatgttctgtcgcttcataagaagggccagagcttcagcctgatttttatcatctggaaccatccggaagaggttgtcatcaagggagagggaaaccgccgtactggacggggcaataagcagcatatcattctcattggcatagggaaccattgcagctgcttcttcactggttgaaggaccaataaccaccataacccctttttcatgaagctttttcagggcattcagggctttctccggatcgctgctgctatcttcaatcagaagttcaacgtgaagattatctgatttaagataatcattcaggatatcaactgacaagttcagagatactttcggagatataaccacgagtgtctcctgggtttttataccggaaacgacaattgatggtttatgccatacaggcggtgagagatttatgaaaaacagtactatcatccttattctcattcttacaactcttctgctcatacttcccgtttcagtcgcttcacaggggtatggaaaccgattccagggaaatcagaatagtgtccttccggaaccagaggacctgaatctctctgatactgaaagatcagatctcctcttcatgcgggaagaagaacaaatggcccatgatctctacatggtgtggtatgagatgtatgcaattccgatcttccggaatattggagaggccgaaacaatccatgccagtgaagtgcaactcctccttgacagatatcaggttccttctgacatgatcggaaattattcatcaggatataataatccggacattcaggctctggcagatgccctggcagagcagggagcacaatctctgactgatgctctcaaagcaggggtagcaattgaagagacagatatcgcagatcttgataaggcaatcgccaatactaccagaccggatatcatccaggtatataccaatctccggaacgggtcggagaatcacctgagtgcatttacccgtcaactctcttaaatttctttttccagtaattacacaggtgcgatgaaggaagacctgtgaaccaagtgaaagatgaaagatatgaaacttggcaaaaaagagagaggtgtggttttaagatatcactcctcatccagttcttcaggctcttctccgtgatcacagaaattatcctcatctaaatcactccagagcggacagcctggacaactgcaatgaaaccctttcggacaggtccctgcaagggcatcggctttttcccgtgtatcttcatctatcagcgtcaggtttcctgcattgtcggtaattaccttcttctcttcggtttgtgctgcaaggagggggtcctggcatccgtcccttccggatgcggaggcagacagaacaaacccgcttatcatgctcattaggcacaacatctgaaaaattgttaatatgtgtttcgtattcattgtacactccttatgagatcaaattacgagccattctccggataaatcctctaaactgatatatatggaccatcaccagtacggtcatgagtaatcctgaccagtcatgaagatccgtaatcagagcaaccggaacctggcggtacgtcagacccagagcaggtatcagacctggccatttgagaatgccggtcactacacagatgacggttacaatgaggaggagaagactggtgattctgatgaaagtttttctacccataattccttactccagttgtttttatacgaggtttgcacagcatgagccatgtctcttgaatcactgataaacagccgattctgaagtttatgaaataatggattattgaacatataaaaaaagcactatcattcaggttcacccttacaaccatccggatcagagggggaggtgagagcctgacttgtccacagaatcccttatcccctctcaatgaaaatctgatgagtacatcagcagtctgtctgattttgagtaatatatgctctattgcggtatcaccatgacgctcatagatattgagactatacaaggactatccagagaccaggtagaagagcggatcaagacattcggatataacgaacttccaaaacataagaaagacggtatttttgaggtcatacttgaggttgccagagaaccgatgttcctcctcctggtaacgagtggtcttatctactttttccttggtgatatcaccgaagctgtcatgcttatgagttttgtgctggtcatcatcggtattacggtataccaggaacgaaagactgaacgggcactcgaagccctccggaatctctcaagtccacgggctctcgtaatcagggacggccagcagaggcggattgcaggacgggaggttgttcccggtgatatcctcatcctctcagaaggagaccgggttcctgccgacgggattctcctctcatcgaataatcttaccgttgatgaatcactccttaccggtgaatcggtccccgtacgaaagattccctggactgaagggctgaaagagcaggctccgggcggagatgatcagccattcgtatattctggaaccctaatcgttcagggtcaggcccttgctgaagtcaaaagtactggctctgggactgagatggggaagataggcatggttctccaggaagtcgggcgggatgatagcaggctgaaagtggagatatcctcgatggtgaagatcatcgcaacatgcggtcttctcctgtgccttatcatcgttatcatctatggaatcggccggggagactggatatcaggacttcttgcaggaattactcttgcgatggcgatccttccggaagagttcccggtggttttaacggtttttcttgcgcttggtgcatggagaatctcagaaaagcatgtacttacccgtcaggttcctgcaattgaaaccctgggctctgcatcagttctctgtgtagacaagaccgggacgcttacgcttaataaaatgaccgtgcaatcctttttcgcagatgatgaattctgtgagcatgacggagccggtgaaaattcggtccctgattcctgtcatgaactatccgaatacgccattcttgcctgtaagagagatccctttgatcccatggaaaaggctcttatacagctctcagagggagattttggaagaacagagcatatacataaagactggaagctcataaccgaatatcctctctcatctgacctcctggcgatgtctaatgtctggcagtctccggacggccgcgaatttatcatagccgccaagggtgctccggaagcgattgctgatctgtgtcatttttcggagcaggaacagaaaaaacttgcagagcagatagatgtgatggcatcaaagggccttcggattcttggcgttgcaaaatcatcatttacaatttcggagctcccacgtatccagcatgacttcgtttttacgtttcttggccttatcgggtttgctgatccggtcagaccggggatcgctgaagcggtgagcgagtgttatgctgccggtatcaagatcattatgataaccggtgattacccccgtacagcccagaatattgcagatcagatcgggcttttgcataccgataacacagttaccgggactgacctaaccgagtgctcggatgatgacctcaaagaacggctcaaaacagctactgtttttgcacgtgccgttcctgaacagaaactccggattgtcagagccctcaaggcgaataatgaggttgttgtcatgaccggcgacggggtgaatgatgcaccggctctgaaatctgcagatatcggtattgccatgggtgggagaggtactgatgttgcccgtgaagcatcttcgctcgtgctccttgacgataatttcacctctatcgtctctgcggtcaggcttggacggagaatatatgataacctcaaaaaggcaatggcctatatcttctctatccacattccaatcgcgggaatgtcactcattccggtcatttttgacatgccactcattcttatgccgatgcatatcgtcttccttgaactcatcatagacccaacctgttctatcgtctttgaggcagaaaaagaagagcaggacattatgaaccggccgccccggtctgcggatgaacgactcttcacaccaaagaccctctttctcagcctgatgcagggggttgtcgtcctcggtgttgtgatgcttgtgtatctttattccctgatgagcgggtttttagaaacagaggtgcgtaccatgacttttatcaccattgtgctcgcaaacctgcttctcatcctgaccaaccggtcctggtcagaaacgataatctctacgattcggacaccgaatacggctatgagatgggtatttgctggaacaatctgcagccttgtcctgatccttgcaataccggcacttcgggatctcttcaggttttctctgataccggtcgaagaacttgtcacctgtgtcctcgctgccagtgtaagtgtgctctggtttgaggcctggaaaatctggaacgtgcgaaaagatcagatacctcatattttttcagggatataaaaaaagaaaaattaggaacggtggccgttcccatgcccgtgggatcctgaccgtccaccattaccggatctcatcccagcctgatgatgcataccggttccatcaagaggcctgactccgttgctttgacagttcttctggatgcaggtcccattccctgaaccataaccataaccggtctcaaactgaccattctgatgagagaggccatgatgatacccggtcccgtcctgtggtccggtctttcctgcaccagataccgggagagtaaccaggagcatgaccagaaccacaagaagtccgatacctacaagacccattgctcttcggttcatgtgactcaccttttcagatttttcccgtactgcattccggttccatcacggggcggggtctgattgttcgggcagtctgcctgtgggcaatccggattcggacaaaccccggtccctgttgaaccatcgccattgtgcagcatcataccattcccatttccaccttgtccggctgctgataccgggaaagtggctcctaaagcgataaggcccaggataaggattacgactattgctttcatatcttctcctgaccgcctgagcggtgcatacatcctcatgggctttgcccggatttatagggataaaatgggagaagttcataccatgaacctgatggttatacagggtagaacttgataaccatggccggcctatgaatgagtgggatgaatatatgaatccggaaagaccagatgaccggacaatccttaccagttctgatcctgagtttatatcagaattatccgaatatcttgatgttctcgccagccccatccgccttcagatcctctcatttatcggaacaaaacccaggacagtcaggcagatctcacatgagattgcgaccagttatgagaataccaaaaaacatctgacaaaactgctctcgctcggcatcatccgaaaagagataggagtctctgatgaaccggtaaacatgggtcagccggttttttattataagcttgtcccggatggtctgaaccatgcagcatacaatctcacacttttcagccaggttgccggaacgagtaacccggacctttcaaagcaggtaatagcggcgcaaaccggcctgcataccattctccctgccagaccaggttttgtcatcatgaatggttcagagcagggaagaatgattgaactgacagaaccagtataccgggtcggaagaattgaagagggatggaacggaatttctcctgaaccggctcttcttctgaatgatgagtaccgatcggtcagccgggtatcacgcccccatgcatgggtgaaaaagcaagcagggttctggacattagcagatgggaacagcaaagggggaacctatataaatggaagaccaatcggtcatgatccggtggttttgcaggacggcgacagaatagaactctcacccggaacccttggcataacctttacctttcattcaggaaataccaatccgaatcataccccatgaaaactaccatcttccccggcccggatctctctctccgaaagaaatcactttacatgtggggagttctgattatccatcttcttcttgcattccagtaccttcttgtggagtttctgtttctatcggccccgattcggcacggacacggaggaggacagggattggggaatgcgataaacctctcccttccttccttctccatcctgttcatgcttttgatactgtgccatatcatctctcttgtaggggctcgtcattcaattcgattcattattggatctggatttggtctggttattacagccaccctgacgttaggacttctgctcttttcccgccagtccatgaaccttcttgagatggtctattctcatgcgatactcgtcattatttcactcatctgctctcttctcattgggatatatatggtgatcagccaggtgtggaaaggtcatgggaatgaaaatatacgtcagggcagagatatatcgtcctttcccctgccgatgaaccgatacagaaatgtcaggcctattggagaaggtggcgttggaagaatctggtatgcagagcggacaggtgatggaacgccggtcgtcgtgaaagtcccacgaacggatgatgaaatgaccggtctttcatttatgcaggagatcagtatctggagagatctggaacaccctcatattgccacacttctttctgcaaatatcctccctgttccgtatattgagatagagtatctcccccgatcggttgcagatctgaaaaccccgcacccaataccacaggcgttgcagatcattcagggtcttgtatccgctcttatatatgctcatggccggggagttatccattgtgatataaaacccacgaatatccttctgactcacgaagggatggtaaaactcaccgactgggggcttgcccggtcagggagagaccgacggtcagtatcggggttttctccaacctatgcagcccctgagcagcgttcggtgtattcagaatgcaccgctccaacggacatctggcaggttggaatggtatgtgccgaactcctcactggcagaccggagatcccgtccggaacagaacctgtctttcagaccggtgaaggagagaaacttctatcaattattctgaaatgtctggtttcagacccagccggacgatatcagtcaatccgggaactttcagttgatcttgagaggattgctcctgaaagaagtgacgattctggttattaaatctgaaatattacaaattttcgattgtaaaagatggtctccggtttcaggctcaccatggagtataatgcatgaccttgaaaattccagtttcagatcttcttccaggtgctcagtaccatcatgagaatgttccatggtgatttttggacaaatccacaccttattgatgagaacgatccaaccggcctctatacctgggatgtgaggaatcctggtaccggtcaattgcatgaatgtctggaccgtgcgatacgatggatcgatgacaggattgtctgactggagattgcaatcgatataaccaaacgagagatgaagatagtggaattatgagacagcatcaggagcctgaaaaccagaaattgacaggctatctaccaatcatgataaagttgtaaatttgggttgaaattctaaaaattagcctcttttctttgaaaatgtctgaatatctaattctataataatcagatcctcatttttataaatcatttaagcatatagtatatttcacctgagagagaccatgaagaccatttctgccatgaccgactggtttgacaacgcaactatcggacggaagattaccctcatctgcctgattctggtcattatcccgacccttgtcctgggatatgtcgcctataccagtgcagaatccgcaattcacgaaagcataaagatcaacctggaagttcaaagtcaggatctggaggaggcgacaaaaaccgcctacgaacttacccaggtcaaagtgaagagtgatctgaatgttctgcatgagcatttttacgcgaaggggaaaccagagatcatcaatgggaacctgatgctgggctcgtcctacaaggttaatgacaactttgagatcgttgataatgtccagaatctgctcggcggagcggcaaccatattccagaagaaaggtgatcaggcgattcgtatctccaccaatgttatcggtgaggatggaaaacgtgccatcggaaccccggtctcaccggcagtctatgatgccgtcatcaataaaggacagacctattatggcacggcaacggttgtcggaaagaagtatatcactgcctatgaaccgataaagaatgctgcaggagagatcatcggtatcctctttgtcggtgttgaggagggttccaccatcggtatcctgcaggatcagatcaagagtaaaaagataggtgaaaacgggtacgtatttgtccttgacagtaccggccaggcccttattcacccgaccagagaagggaagaatgattcagatcttccattcatcaaagagattataaccaaaaagaaaggatatctggaatattcctgggatggaagagataaaatagcagtattcagttattttgagccatttgactggatcatcgttgcaaatgccgactatcatgacttcaccggtcccattgatgcaatccgcaatactatcttcatagttgtaattctgggaatcatcggtggttttatcgttgccaccctctttggaagatccatatcaacacggatggatgaactggtcacgttggcaagacaggtccgtgacggtaagctcgtcgctcagacagaccgggtgtattctcaggatgagatcggtatcctctcgcaggctttttcagatgttgtccatacattcctccagttcagggatgagatccggactttgagcacggctgcagcatccggaaatctgaaaaccagaggggatagcaggaaattccagggtgattatgccctcatcatcgatggagtcaatgagaccgtggatgcgatggctgttcccctcaatgaagccatgattctatccaaacggtacgcaaccggtgactttacggcacggatgaaccctgacctccagctgaaaggggagtttgtaacattcagggatgcccttgataccattggtattgatgtgtccaaggctcttgcagcggttcatgcacagatgaaggaactgacagaagagatgatcgaagtcagtaaacgggttgatgaagtcaatgctgagacaaacaccgctcataagagtattgaggatgtgtcagaaggagtcggacaggtagcatccatcgctaccgcagtgaacaacctggcagataaaagcggtatggcaacgcagcagatcctgactgccatgcaggaccttgcaaccacggtctcttcagttgcagcaaagatggagcatgtatcggtactgaccaatatggctgcagaactctcagagaaaggaaaagatgctgcaggtcttgctgagaaggggatgcacgggatcatggagtcatcttcagagatagaggagatgaaccagcagatcagtggtcagatgcaggagatcaacaggattgttgatattatcagctccattgcagaagagacaaatctgcttgccctcaatgctgcaatcgaggctgctcgggcaggagaagcaggccttggctttgccgtcgttgcagctgaggtcaaggagcttgcaaatgaatcgcaaaaatctgcagagaatatcgcgttaatcatctccgaccttcagaagaaatctggtgccatggcaaaggcagtccagaactcgataatagaagtcaagagcgggaatactgccgttggtgaaacactggcagtctttaatgagattgttgagtcaatctctacgatcaactcgaatatgagtgaggttgccgcagcaagtgaggagcaggctgcatcggtacaagaggtcacggccacggtgaatgaattcagtgatatggtgcagcagacggcaaaggagtcggtcggtcttgcagcagcaagtgaggagtcatcagcagccgtcggacagatcacccagatggtagcccaggtaaatgagtctatggagcggattggtcagactaccgatcgggctgaaaaagcggtggccaggatcaaagaagagatggaccagtttaccttttaattttttatattcaggcacgtgagacgagtgagaaagtcacgaccctttttttgtcgccaggaatatagtatctgatgggtgatatcgacatccgtgtttatttttcacctggtgcaggccttcttgatctctccggactttttaaaaatatcctgaagatctcttatgaagcggtttatgttggtcccaaaagagcaatacggaaagaattaaatgctgcgaatctcaccgatacgcatacatatgagaaattggaccctctatctttgtaatatcacggaccctatcacttccaataaggagtctatatcagaggagaatataaaaatcgcggtgtctgatgcagtaaatccaagttcaattcttttttgtgaaacctcttcaatgtaatacctcgtctctctccattcatccccgtcaatccgttcaatagttccggattgaatattttttaaaaagacattcaggaattcttttgattgctgctcgagttctgcatccttgatggtcacgacgatgagtaatggcagcatgctgttccttaacccagtcagcaagtaaaatatcagagtgtttttgcagtatttcagggaatttgtatgtaatagccacggtaacacctcggggtaaacaacacattttcttccatacattataaatactacgatatgattaccacaaaaagacatcaaaacacttatgttacagaaaataatacgtaacgataagtacaggcctgaaatgaacagaacaattttacaggaccatacatctgcacttcatgtccttgtcgtggatgatgaagaagacgtcagattagcaaccgctgagtacctggctgtcttacataacataaaggctgaccttgccggatcaggagaagaggcgcttttactacttcttaatacccggtatgacgctatcatctcagattacgagatggaggatatgagtggtattgacctcctaaaaactatcagggcacggggtgacgatactccgtttatcatattcaccggacggggacgggaagaggtggttatcgctgcttttgagaacggagcagacgggtatgtcatgaaagggggcgagatacgatcgcagtttgctgaacttgcccagaaagtgaccaccatcgcacagaaaaaacaaaccgagaaagccctcagtgagatacaagatcagttcgcagagatatacattaactcaccaatagcaatcgagctctatgacaaggatggcagactgctggacatcaaccctgcctgttgtgatctgttcggtgtgcactcatcggatgacgtcaggggattctccctctttgatgatccgaatgtacccaaagagaggcttgaagcattaaagaaaggggagacaattcgatatcgttcggtctttgactttgatctggtgaaaaatttaaatctctatacaaccagctctggtgaaaaatttaaatctctatacaaccagcaaggcaggaaagataaccatcgaagtgcagattaccccgatgtatcatggcgaccaccagctgtcaggatacctggtccatatcgttgatgtcactgaagaaaccctggcacaggatgagataaaaaaccagaaactattcctggaccggcttttggagaccatcccgatcccggtcttttataacgatacaagagggaggtatatcgggtgtaatcaggcatttgagcactatatcgggttcacaaaagaacagatcgtcgggaagacggtatatgacattgccccacaagaacttgcagatacctattatgcaaaagataaggaacttcttgatgccccaaagacccagacctatgagtcacaagtatggtatgctgatggaacaatgcacaatgtcatcttctataaggcgacactccttgatcaaaacgggaacattcagggcttaatcggaatgatccttgatatcaccgagagaaaacaggctgaagaggtaatccgccagaaagaagaatacatcagaactgttcttgacaaccttcccataggtgttgcggttaactctgtatcgcccacggttgcattttcctatcataatgccaatttcctgaaattttaccggatacctgagaaagcactcaaagaacctgatgttatctgggattacatctatgaagatcctgaatatcgcaaaaacatacgcgaacgggtgatttcagactgtgccagcggtgatccaagccggatgcactgggacgatatccccatcatcagggaaggggaagagaccacctacatcagtgccatgaacattccgattcccctgagcactctgatgatatcaaccgtctgggatgtgactgcaagaaagaaggcagaagatgaactcaaacaggcaaaccgtctccttgaagggatgctcaatggtattcctgacatcatcgggatacaaaatcctgatcataccatcatccggtataaccaggctggatatgatgccttggggctctcgcctgaagaggtcgcaggaagaccatgttactccttcatcggacgaaccagaccctgtgagatctgtgcaacatcaaaagcactgcagagtaaaaaacaagagatggtcgagaagtatgttcctgaactgaaacggtacctgatctgccggagtaacccgaaccttgatgatgacggaaatgtacagctcatcgttgaacagctgaccgacatcaccgatcggaaacagattgaagaggccatcggccagtcaaaccagaaattaagactccttaccggccttaccaggcatgatatcctcaatattctcaccgctatttatttttatcatgaactggccctggagaattcggatcctaataccatacatgagtacattaccagggcacaggaggctggaaagcggatagaggcaaccataggctttacgagagagtatgaagagttcgggattgtcagttcagggtggcaggaactatattccatcatcgaatctgcaaaacgtgagattaatgtcggggccattcggatagagaaccagatctccacgtcgcttttagtatatgccgaccccatcataagaaaagtcttctcaacccttatcgagaatgccatccgccatggcaaaaagattacctatattcggttttcagtcgcacacaaggataatgaccttattattatctgtgaggataacggagtgggtatacccctcaacgacaaggcacacatattcggcagaggatttggaaaccataccggtataggactcttcctggcacgggagattctctcgattaccaatctctccatcagggaagttggtgaagaagggaaaggggcacgatttgagatccttgttccggatgggaagtggagagaatgaacaggaatgaatcattcacatgaacaggatacacagaacgatatattgtggaataattcacctgctctttataggcctgatattcggacccataatggcatttgtcctctcgccagagaatccggtgaccatcggtgaatagaatgatcttttgacgaaaatcacctgaccggagggagatgtaaacgatatccatatgtaccatcttgacaaacaatctacaccgatccaggtcagattatgaagcaggtaactctcctcctcgttgatgatgagcccccgttccttgacgcaatacgggattatctctctgaatatacagaattttatatcgattgtgcactatcaggagaggaggcattagaaaagatcaaaaccggccggtatgatgttgtggtttcagactacaacatgcccgagatgaccggggttgaattgctgaaaggagtcagatctttttcccggataccgttcatcctcttcaccggtatgggtgagcgggagataatcgatgaggcaatcgaaaataacgttgatttttaccttgaaaaaggtgaggaactccatataattgcctttaaactctcacagatgatccttgccggagtgtaccggagccagaaagaggactccggggtctgaaaggggagatcctggttttggcccaggatggtctcacgcttttcaccagaaaacaccccattcgacccatatttctttttcatgtctccaaggtttactgttcctcctcatccggtattgtagattgatcgtatctcagcagggaacatctcctcatcaatggtggatatgccccgtatctctccccgtaacttccgctgatttatcgctgaattgaatctgataccatctggtcccccggtctgatacagccctggtgaagcagcaatcccactagagtccagaatccgtgaggcaacttctgcaccattcacaaacaggcggatagctccactcgtctgattataaaccccgactacatggaaccactgatcctgcaccggcccggaaggtgactgaatatatgatgcagacctcccacctgctgccatctgtgccgtacggaaggcaaactcaaaccttgaattgtcactgctatgctgaagatgaaaccgccggttactgtcacgatcaccatcaaccaccaccgttgcccatttctgatccggacttgtgggagaaggcggggaggtgaacctgatccaggctgataccgaatatccagctccccgaagaaactctggtgtagtattattctgtgacgtattcaccggtgttccattaataatgaaggtctttgaatacaccagcacctggttcagggcatcgattactgatatccggatttcatttccaggaaaattgagtcttgatccgggaatctgtgtcctatccgcagtcacgacatagccagtatcagaatgggtgatgaagagcaaggttccaggcttccatatctgcccagggggaagtgggactacaactgagctgccatctaccgtctcgatacgaattgtgagtggatatccgctccctccggtattcgcttcagataaatacccgggatctccctgcagatgcatgagggtaattgacggatatccgttttgggtagaatattgtgcatccacgacaatgtatgctgatttaaaactcatgccggataaaaaccccattaaaacggctgatataataccggttaagagtaccatcagaaagagtacaaggatgattccgataagagcactcactgctgattctctcttatccaaacgaaaattattcaataattcatggattaatgtcataatatgagaacatcaggcataaaaacaatcagacacccatcatattttcttatcttttcctatccattctgatttatctttgtatgcacattcacggcatacggtatacactgaacttcgataccgacaggtacagagatcctcctttgctcttctccttctgttctgtgcatatattatgagagcaataagtatgattgccgcaataacaagaccagctgtaacagacacgagaagtatggtttccatatcgaaaaggagaaccatcgtcaaaaacagtataccggatatcatacaaccgatacatatgcccaggtacagagctccattcataccaaggcggaatgatatttctttgagcataacggagaccgtccaatccgatgtgtgatcctatccggattggatgtaatcataattaaatgtaatccatagaaaaacttattcaatcccatatttctttttaatatcttctaagcttatagattcccctcttcgatgttcagcacgtgcttcttcagatcttttctcccacccggaataatcacacgtcatgaatatatccatccacctttcggaatctgtatctcaaaccgggccccgacaccatattcaccgatctcatgaatctcaattccggtcaggagaagaatatccctggcaagaaacatacccagaccggagttcttcccaaatcctctctcgaacacctcttctttctcatctgcaggaatcccgaccccgttatcttcccacacaataaccagggtcgtatcagtcatgtgtgaagagacatggatctctgtaacccgctgaccatggcggatagaattatccagcagattataaaacaccttttccagcatgggatctgcaaagacagagatgtcgggtaatgaactcttaaacaggaccctggatggcacattcagccgggcaaggatctcaccagtcttttgccataccggttcgtgtaatccgatatcctcaaagaccctggtaaactctatctggccctgtatcatcctggttgcagaggtcattttgccatatgcttcacacaattccggatctgcacactccccttccaatcgttcaagatagaggagcaggacggtcaccatgttcaggatatcatgcctggtgatactggacaggagactgagctgacggtttgcctgttttaaagccatcttattcttcttcagttcggttatatcctggttggctccatgggtccgaatcgtttaacctttattatcctttgttatcccgaaccggacctaaatggagcggacttcaccatccctgcggataatccggtgctcacgctgggagataaaatcaggatcggaggcggtgagggctttgtgctcctcttcagcaaccacatacagatcatctggatggacaaactcacgggcatatgtatccgatgacatcagatatcccccttccttctctgctgttgtcccgtacatggcataaaaccggtcatcaaaggtaaaaatatcagcaaccgcatcatactcccagtttaccaggtgggcaagatccatcgcctctgcaagcatctgctggttttctctgagcttttgttcaatatgggaacgctcaatatctgcagcagccttaactgcgatgatatccagtatctgcctgacatacagggaggtctcaaagggtttctgaaacagggcacagaggctgcctattacctctccggatgagttacgaagaggggttccaaggtatcccctgaattcatacttttcaagttctttacatgcaggaaatgcaagggagatctcatcattatactgacaaaaaccacctgatatcacctgttcacagggggttcctttcagggaaaaactgacagaaatgtactcatttcccagaaggaccatagagagaatgttgatgtccctgtgatcagcagagatttaaccgagtaatacgcagtcggcatgaatccaggactgaatggtgcatacgatttttcgaagggaattatacccggttgtcccgaccatgctcaccatcagggcctgggttgcaagttcagtctttttccgttcggtaatatcccgaattaagacctgtgccccggttaatatcccctgctcgatcaccggcactactgatatatcgatatatgcctgacttccatccttttttgtgagacatatctcgatgttatccagagcggtcccttttttaagttcggctacaacttttagaaactcctgctggcaatcagaaaaaaccgtatttgcagcgccatcaaccgcttttccgatgagctctgaaggttcataaccgttgatattttttgacgaaggggagaggtatactgcctccagttccttgttcaggaccacgatcagatcagatgaatgttcagccataccccggaatcgttcttcacttttccggagtttctcttcaattcttttcaactcggtgatatcccgtattgattcgatggaaccggccacatcacctgatttattgtataacctgctgacacggacgagagttgagatccgcgtttctttcggggttgcatgactggtctgtgcattcagacacccatcttttcgaaaaacgtatgctctcatggcggttcattttcatcgtggacataccggtcggccttcttgcaatcatcctcggttttctctgtatccccctgctcaaaccaacaagtccgtcagcaaaactggatattccaggtattctgctcctattcataacccttgcatccctgatattcggattgaataccatcaccggtccaaatgcttcccatggcatcatagcactggtgctggcagtcatcttctgtttcctcttccttgtcaggcagaagagatctgctgaaccgctcatggatctctcactctttaaaaaccgggcgtactcatttcagaatgccgatattctcatccttcagttaggacttgccggagtgaattcctcatgcccttttatctggagattgtgaaggcactcccaactggaacctccggagctcttcttctggccctgccgattgggaacatactcacgggtcagatttcaggaaagatatctgatgttatcggtacgaaaaagccaattatcattgggtttatcgtctgtgtattcgctctcttcctcctatccacgctgtcggttgagagtcatgcctatcaggtggccatgtacctcttcatcctgggtgcgggagcgggagttgcctatggaccactcaatagtgcaattatgggagaatcaccggagaaggatcgggggattacctcaggccttctgaagatgatgacaaattttggatcctcccttggtgtagccctgacattgcttgttgccgggttagtcatgggaccaaagatggccatggtagcagcccatacgataaaacctgcagagataatgccggcatttcagtcagcattcttcttctgtatggttctgcagatatgggactggttcttatcatcctggtgaaagagagacaggctccaatgtcaggtccatatgaaccgggggtataagcatacctatatcatcatcagctaataggtacataccatgagcagaataccagaatacccgtttgatcctgcagtgtcagaagtgatcggagaaatactgatggttgcgttggtggttgcactggcatccatcgtctcagcctttatgatgggccttatcggatcggtccctgataccgcatttactgcatttaaagccgatcctatctacaataataccacaaagataattgatgcggtcagtgtactgtgcatggcaggtgagggaatcagtggacgatccggggagagtgccggtccgggagcaggaaatgaactcaaagacatgagtattcatatctcccctccggatggatccagtcataccgtctccttgtgtgaggctataggatcagctccgttcagagtaggaccggggacccagatatttatcgtaaaaagagggggaacatacttttttgtgaataatccaggccagaccgggtgtggtgacggtggcgggggcaaccaagagctgaaaccacacggactgtggacgataactatcgctgataccctgaaatccaatacggttgtgtataaaggagaggtatggttataattatcccattatcctcttaccattccactgtccagaccaactctcctctgattcatgcttccattttccggtaaatgaggtacaatcatcactcatggtaaattccaaatcaccagactcatcaattattccatctgattcttcagaccatttaccaattaatcgattgtcttcaactattccagatattttaccattatcatgctcataatttccctcaactacatttcctttctgggtaagagtcatcctctgaaaactcgtatcccagattccattccactcacattcggtatccatagggataatggcattttgttcagagtaggtaatctggtcctgtgaggaaggctcaatttgcggatgtaaagtcgaaatcggttgtggaaaaacggtctcttgtattccggtctgactatttttatcggagatcacctcatattcttttgcataggttttctcattaccggttttaggctcccatgatctgcgatatacagcatggaaggtctgactcccttctctcactgctctgatagtccagatatgcataccacctcttccaaccattccttccttcgattccgaccgataagaatcactgacaatttcaagtcctttcgttacggttacctcccactggaatcctgtcgtgggattttcggagagagaaatttcatccatttctccaaggtaaatcctgacagggccttcagtctcagtcccggtctgggtaaccgaagcagaaggcttctctacctctgaaccagtatctgatttactgataacttcgggttctatgactgatttattgccagtatttgcatctgattcatctccaatcaaaatatgtgaattgggcaggaccgtgaaaaagaattgcccgggtgtctttatgattgcttctccataatcccccgtgaacacatagtctcctaaatagatgactgaatttaatgttggaggattctcctcgctactatcagatggatgatgcaacctgacaggaccaattatataataaaatcttgctccggaatctatacgttttccagatttttgtgaaggagaaggaatctctgcagaataagatgaatctgaaccagtattagagagaatatttgcatgaatataatctaccgattcgtccatgataccaatatgaggattattgtctcccattactggaatcgtaaaaaataatatcaccagtatacataagaaatgaatttggctcatttgcctttaccccatatacctgcccataggttttacctcttcaaataccttttggtaagagaatatttcggactcaagtacaaataacctgcatataagccatagtatgagaattgtggataaccgggtaaatgatagaatagaatgatgaaccttattattcatacaaagattcattgttgtgaaaaatacaattcattggattaaaccataatggaatttcgaacatggaaatatctgaagaagtaatagacgggattcgagaattaatcacaataggggtcggtcattcagccggaatgataaacgaactgaccaaagctcatgttaccctgaccgtccctgaagtcaggatatttgatataaaccaccagacggccctatctgccctggatgtcaccgatcctgatgaatcatcccaggtaattctctcattctccggagaatataccggttcattaagcctcatcatcccctataaaagtgcaatacatctcgttattctcctgactggggaagagggctctcctgatgagatggatgcactcagggttgaaactctcattgaagtcgggaatgttgttatcagttcggttatgagctcattctctatccttctctcatctcctctcacctttctctacccggtgtaccggattggaaaatgggtggaaaattctcttattatcaattctcaccccaaactgggaatcctggcccgaacgaaatttcagatccaggatcgtgagatcgagggctttttattcttttcaattacatcagaatcatttgactctatgcagcaaaccattctggagatcatggagaaggggctatgacatctgattatgcatccatcatctctcaaagcctcaataccctcccggttggtatctgcatcatccgggaggatcacaccatcaccttctggaaccggactatagaaacgtggaccggtatcagccaaatccaggctgaagggagggttcttgaggatgttgttccggtgttcagagagcatcatgaaaagtcacggctgaaagttgtatttaaaggaggcggaccggtcatcctctcatcacggttccatccgcggatttttccactcagggataactcccagaatgagggaaaatatcagcgaataataatatctccctttattcttcaggatgaaggaacacaggcgatcatcacggttgaagatgtaacggccattaccgaacaggtcttcatgtaccggcagataaaagaccagttggcctttgaacttgaagagaagaaaataacacaacgtgctcttgagatggccctctcgaaactgaataacctcgcttcaatcacccggcatgacctgttaaattctctgacggtctttgaaggatacttagggatcattctgaatcaggaacctggaggaaaaattcagacgtaccttgaaaagatgagagaatcgacgttatccatgaaacggcatatcacctttgcccgtgattaccaggagatgggtaatgctgttccggcctggtaccacgttgaatctttggtgaaaaattcaggaataggaccgaacttccgggatattataatagaaaccaataccggaaacctggaaattttagcagacccgctcattgtaaaagcggtgtacaatctgctggaaaatgcggtccgtcatggagaacataccacccacattacggtgtcacatgtgaagggccctgatagtgtcaccatcattcttgaggataatggcgttggggttccatcagataaaaagggacgaatttttaacaaaggttttggatcaaataccggtcttgggctctttcttacaagagagattctgggtatcaccgggatgcagataatcgagaccggaacaccggggaaaggagccaggtttgagatccgggttcctgccggtcatttcagatatccgggagaggaatgagatctgatattgctgacatttccacaatctatttctcaaatcccgtcattatgattatcaatgagcagtatcttaatcgttgatgattcagtatttcaacgcagggtcgtcggagcccccttacgtgccgggggatttacggtccatgaagcagtagacggaaatgacggccttctcaagataaaagagttacaccctgatcttatcctccttgatatcctgatgcctgaaaaagatgggctgcaggtcttaaaagaacttcatgataccgggaataccataccggtcgtgatgctcacctctgatgtgcaggactcgacccgggaggaatgtctctctcttggagctcaggcattcctgaataaacctgtgaaagccgaagaactcatcccggtgattacttccctgatcacgaaagaatcatgaaccatatcacacagccggttctcgacgggatggtggaactggtcaatatcggagttggacgatctgcagggagcctgaatactctgaccggccatcatgtcagtttgcgggttccggagataaaaatcattagggttactgaattgaagaaggaacttccctgtcctgaccttccatttaccgtcattagccaggattatagtggtgcttttgatggcactgcaatgctcatgtttccgcaggagagtgctgaaggcatcttccgtctcatgatcggtgaagagaaaaaaaaccagacgaatgatgaactctggcagatgactttgactgaaattgcgaatatcattgtaaatgccgtcatgggatcaataaccaatattctggggaaaaagataaagttccatatccctgaataccatgaggattcactggagcacatcctcaccgattcccggtttctcggcgaagagacggttgcagtcgtgcatacgatctttgaagtcagggaaatagagatatccggaaagattgttattctcctgactacccgatcgatcgagacgattgcagaatttattactgaaaagatggcataactctttttttatcgtccgggtaaagtattcacattcttcaaggtatgaatgcactttaccggcaggtaatggtacctgcctgaaattcttccatgataatactcatatctgtatctttccggaagagaaccagaattcagagtactggatgacaggtaattcatggtaacgatatttgcaggaaaaaaactgaatcatgcatctgaagagaaggaaccggttttagtcaatcggtttcccatgaccataatgctttaagagaaatgcccgaactgcatctgactgaacccatccgtgatccagctgggtaacaagggcatcaatacgtttcacctgctcaattatttctatattctctttcgtatcttccagtgaggcaagggacataatgattgcaagaggatttctaatccggtcattgaggatctgaaactgttccatattatgctcaatctgaaccagacctttcttttcaatctccttttcaatcctgaccagggcagagacatcatgaaactgaccaataacctgaataaccccatccgcggttataatagggacgatagaacaatcaaaccagaaatcctctccatcgtaggtgaaatgatgggttgcatgaagagaactgccatattcaaagaccgtctggatctgcaccgcgatcttttcgtaaagatcggatgggagaatctctttcagagaaggatatggcgaattttctgatgggagatggaagaaagccagggcacgggaattgagaaatgcaatggatgtatcccggttcaggatgaagagcagatcttcagagagttcagcaatggtccgataccgtttttcgccctcaatcagggccttatccatggcatgtttatagagagccatccggatcgtggtatgtaatgcccgttcatcgagtggttttatgagatacccgaacggctctgaatgaaccgctttctgaaccgttgcttcatcagaatgggccgtaaggtagatggccggtatattataatctctgcggatggtatcagcagcctctattccggtcatctctccccgaagtgtgatatccatgatcataatatcagggcggagttctccagcctttctgactgcctcttctccggtatcaagaatatcaaggacctcatatcccaggtcttcaaggcgtgcccgtatctcaaggccggttacaaactcatcttcaacgacaagtatacgggtggctgaattcattcttgtctgcctctgtcagtgtgacaatgccgggataggaactttgtatatgatcacggttacctgatatcagctgaagctctgggtatcctgaagtctacgtattatcatacgaggagatagagattgtgatcatcatattctcatatattttacgcaaagccgggcatctatgccgggcatgacaggagaggatgagaggagaggatgaacgaataatcaggcaggaagatcaggcaggaaattcgatgatatagccaaacccctggtacgtctcatatctgaccgttccattaagttgtccggcaagacccctgattaactgcatccccagtgtatcgggtttctctatggcccctttgtcaggaatcccaggtccgctgtcctgatagatgagccggtaccgggagttttccaaagagaaatctatgcgaatttctccagacagcccctttggaaaggcgtgcttaattgagttggtaatcagctcattgatgataaggctgagtggaacggctttctcaatcgagaggaatacatcttctgacctgaccttaagaagaatagtccccggggatatctggtatgattcaaagatatggtgagcgatcttctccaggtaatccttgtaatcaatcctcttaaaatcttctgactggtagagtttctcatggacaagagcaattgacctgatccggttctgcgactccagaagaatatccctgacttccggttgctgtgtggaacgtgcctgcatgaagaggagacttgagacaacctgcatattattcttaaccctatgatgaatctcctttaagaggatctctttctcccgaagcgatgttgctatctgttcttccatctccttctgtttggtcacatcacgaaaacctgatcggggatcctgccagggttgcatatgccccttccatctccttctgtttggtcacatcacgaaaactaaagaccctgccgacaatggtgtactcaatcctctggggcctggatgtccgctcaagaatccggttatcagccaattcaatgacatcaaaggagtcaagttctggattttgatagatctcagcaattctggaacagaaatgatccggattctgaaccctggatgcctgctccttcaggattacccgctcatcccgtaatcgcagcacggaatcaggaatctgccacatttcttcaaatattttattatacactgagatattccggttattatccacaactaaaataccatcgggggtggattcgatggtggctgataaaaccgagagagtctcaaagagtttcttctctgcagagagtcgttcttctacctctgcctggagttcttcattgataaactgtaactgatttgtccgctcaatgacccgctcttcaagctcctggttcagggattgtatcctctcctcattcgcttttgattttgagatatcaaggacaaatgcgactgcttcttccctcgcctcaccaatgagcacatatccggtaagcacccaaatccgggaaccgtcccttctgatatactgtttttcatatggagtgcaaacaccggtctcgtgtgcctcggttatcgcttcagcatcacgggcacggtattccgggggagtgatatcggtccatttcaccccatccctcaaaaactcctcccgtgtatacccaataatccggagaaactcatcatttgcctcaaatatactgccatgaatatcagaaaaaactgaaccaaggatccgggagttaaataatgcagacaatttttcctggttctgcctgaggtcttccatgagcaggtatttttcagtgatatcctgaatgaccccaaacactttgacgggttttccttcttcatcataatggagctctccgatagaggacaggtaccggtcttcggacccatcagcaggatggatacgataggtggtatcaaaaggaatattccgttcaattaaatcatgaattgcagtagagatccgttcccggtcaggaatacaatccagaatttccgttatgtcatgcaaaccatccgcaacaggggaaagtccatagatacgacatgcctcctttgttgcccagaccttcccggttttgatataatactcccagataccgacacgacccgctcgttgtgcttcagtgagacgatgattcagttcagtcagttctctctcactctgcctgaccatctccatctgatcacgaagttcttcctgttgtgaggccagctcttcatatgaagcgctcagctcctcattcatcgcatagagttcagtatttttctcaagaagctctgtctcatgcgcttttcgttcacttaagtccctgattatcgcctggatataccgtgtcccctgaatatcaataatcctgatactatcctcaaccggaaagggagtgccgtcctttttctgatgttcggttgtaagtatgagactgttcgtttgggacaggcgaattaaatcttccggaatatccttttttgctgcttctgaccggagatcaaaccactttttccctttcaattcatcaggagaatagccgtacatggatactgcagcatcatttacttcaaggatataccagtctttatcaaggatcaggattggatcattggcctgttgcatcagcaggcgaatccgttcggcaaggaacaattcatgctcctgctgctgtaactggtgactgatgaactcattctcccttgttttccagaatatcagtacaccaagaccggcgatacataggaggagtacaataccccccatcacaaaccggctgaactcggtgaagtgagcatatatctcatcctggtcaattttcgctacaatgaaccagggagtatcagatatattggtgatcgaagcaacaaccgggacaccacgatagtcatctcctctcacgatccccttatatccctttgccgccataaccgcaggtacattctccttactggccggaatagagagagaaagacttgcgttcggcacatgacgaaggtcatttaaaaacagaacttcatctccgaccagacggacgataagggattctgcacttctggttggggtgggccaggtctggatcagcgggaagagatatcttcctggatcgatctgaaagaccaggactcctaaggatctttcacccggacggagacggaccgggacccagaactccatctgaacgatgcctgattcagggtctttgaagatgtcagtgaagagtggagtatcagaatcaagtgctcttttcagggttgtgtctgagctataaccggatactgatgcagtgtcagggacagatatcaccatctcaccggtccggttcagcagtatgatgccccggtaatcataactggctaccagactgtccaaccaggcaatgagatcttccctggaaacatcatatttttgggagacttccagattatacagatactgagaggggatctgattcaccatggcaacttcagcatcagagtaccgctcatgataccagtccgtaatagtttttgcctttaattgtgcgacggtttctagttcagtggttatctgtttttctgtctcctgatgctgactttcaatggccagatatccaatcagaataatgagaccgaaaacgagtgataatccaaggatcaaatacaggaaatgctgtttattttcagaaggagaagatatcataaagccccccgtccccggagttcattctgaaacaggtgagataaccgcggcaggaatgaataccatggcagtataccatcaatattccaaaaaacccctcttcattccatgttctgttcatgacccatcagcatgcaatatgtatgcaataagtatccaattgccctctgagtatttgagtactttccctaccggttcacagaagatataccgatctgataccggagaaagagagataaaaaaggatagaatgattagaaaattgtgaaaattgtgagaaaaatgggaggtactcgttcatagacatacctcatatacaagaaatgtcgatcattgtactatatatataagaaagataaataatccgtttatgaaactccggacacgggttcttttgttatatttatgcataattacccttgtactcgtctgtctgggagttatcatgccctcatcaattcatgaaaaaaacctgcagacaattcatgccgatacagagaaccaattacaacatattgactttgcactctccaattttattcaggaggttgagcaggatatttccgaactgctgctgcatgatatcataacagacccggatgataccgggtttacaaattttctgaatgcatcagaagataccttcgtctattctatcggccctcgggaggccaaaattatcaatgatctgaatgcattcaggctcacccacccgtcggttaattcggtatacatgggtcgggagactggcacttttgtcagatcccacccccggcccaggccgacccggtacgaccccagagaccggccctggtacatccttggaaaagagaacccggataaaatcatgatgaccgagccctatatgtcggtcacatcgccggatatcaacatcggcatagtcaaggctctgacctatccgaacgggactgtgtatggtgtccttggagcggacatcacccttaccaacctgaccaggtatatctcttcctttgatatcgggagatccggagagataatgctggtaaacgagagtggaatcatccttgcatcacgaaatgaaagcgcactatttaccaatatccgtgaaagtcttggggaagcccagacagagtatctgctcagcacgagcagaggaattctcaccctcccatctgcatacctcatcttttatacctcacccatgctgggctggaaattactgatcaccatcccgtaccatgagattgaaaaagagataatggcctcaatgatgtacatgctcctctttgtcttccttgcccttatccttctcagcatcaccacccttatcatccttgacaagaccataatccgccctctttcctacctgaccgatattacgaagaatatcaccgagaccgggaacctgaaccagaagatagaacttcataccaaaggtgaagtccaggaacttgcaaaatcctttgaacggatgataggcaaaataaaggaggaagaagagcagaaaaacaaggcattcaacgagttatcatcataccgggaccatctggaagatcttgtcagagaaaggacacagcagcttgaggctgcaaatacggatctcatcaccgaacgaaaccgggcagaagaggcagatcagttaaagtccgcatttctcgcgaccatgtcccatgagctcagaactccgctcaattcaatcatcgggtttacaggcatcatccttcagggtctggccgggccattaaacaaggaacaggagaagcagctggggatggtccaggacagtgccagacatctgcttgcacttatcaatgatgtccttgacatctcaaagattgaggcaggagaacttaatatctcacgggaaccggtgaatattcaaaaatcaatagaatcggtctgcacaaccctgagaaagagtgccgaggacaaagggctttccctccatgttgacatatctccggatacagggtttattatcggagatcaacgaagaatcgagcagattctcatcaaccttatcaataatgcaataaaattcaccgaacgaggatatgtctgcgttaaaagttcgctcagggagaagaacgtatgcatctccgtatcagataccggtatcggaatcagtgaagaggagatgaaaaaactattcaggccgttccagcagatcgataccggaactacccggaaacatgaaggaaccggccttggattatccatatgcaaaaaactcgtggaattacatgggggaaccataatggttaccagcgaaccaggaaagggaagtgaatttacggttatattaccagctggagaagaattatcatgactcacaaggttcttgttatcgaagataatgcacaaaatatgtacctgatccattttttacttgaatcacagggatatactgtgattgaagcagaaaacggattaatcggcattcagaaggcaaaagaagagagacctgatattatcctccttgatattcagctccctgaaatggacggatatgagatcgcacgaatcctccggagcactcctggtattgataccatcccgattattgctgtcacctcctatgccatggccggagacaaggaacggatacttgcagcaggggcgacggattatattgaaaaaccgattaatccggccacctttgttgatcagataaaagtacacttcaaaacccgggaatgagatcgtaatgaatgttctgatagtcgatgatcaatacattaaccgatacctacttgaaaagctcctgaccggatatggctattctgtcctctctacagaggacggcatgcaggctcttgaaacattacggaccgaacacgtagaccttatcatctctgatatcctgctcccgaagatggatggattccaactctgccgtgaggtgaaaaaggatcccgaattggccaaaatcccattcatcttttacaccgctgcatataccgaacaaaaggatcgggaatttgccgaaagccttggggcggacagttttatcataaaacctaccgatccagccgagtttatcgccattatccgcgaccttattcacgaaattccagaagaacatattgaatcaaagaccataatccttggagagaatgaatacctcacagaacacaacaaacgcctgattcaccagttggagaagaaactctcagaacttgaggatgtgaataaagcactcagaatatctgaaaagagatataaaaacctctttgaatatgccaacgatgccataatcctgcatgagataaccccgaatggtgagtttggcaggatactggaggcaaacaatgtggcctcctcattgcttggatatacccatgaagaactgctcagcaaacatatggcagagatagatacagcgaaacagtttgctcattaccaggagttcatgtccacattacttgagaagaaacacctcacctttgagggggagcatatcgcaaaagacgggcatgtcatcccggttgaactgagcgctcacttatttgaggagaacggtaccagactctgccttattatctgtcgcgatatcaccttccgaaaacaggcgatggaagaactgaaacgggcagtatcccagattgatgataatcttcaccagattgcaatattgggggatcagattagaaatcctctcacggttatcatgtcatgctgtgatgaatgtaccatgaaagagcatgacaaggttatccaggcaataaagaagatagatgcctgtatccagaaactggacctgggatccctcaaatctgaaaaggtccggaatgtcctccttggactgaacgggtacaagacttatgaaataaaccctgacagacaacatccggttcagggataaaactcaaagccggtataaccggatgtcagagattcataaaacaaacctatgatgaaaattgcccatatccgtgaacctggtcagaacaaacccctcatgttccaccccggatgctgggcagtgatgatagtgggtatcggtgttcttgggttgtctggctgggcactctcctcacgatctcttgtcacgatcattccggatagtgtgacaatagcaccgatttcagctcttctctttattctgctcggaataagtctctatcttgcggaatatggagtgcatgatctccggtttatgattgttcaggatgttctcctcatccctccggccctcatcgggatatgggtatttcttatgagtttcttcgggaaatccagtattatccactggtacatccattcaccagatcagatctatctgatcgcaccagagagttccatgtcaccggtcagtgctctcttatttctcctgagtgcactgggtctgtacataaaccggtatcagttcagatatgcacccgtccttgcgataatcctatcatctgccggggcgttcctcattatcggatatctgcttggaaatccattaatatacggcatgaatataaaaccaacctcatttatcagtgcattaggattcctcttttgcggaatcggacaattattgtgtacacatcatggagaataacgtcagagacctgctcttcatccatcatccatcggataatccgatattaacagtagtgatatcgtgccatacgacagagagcagccctgttttgactccattatcaaataaaaaggtattggtatgggaagcggactgaaaaacctatatacatggaattcaattaagaaggaatagactcctgcaccttcgtccctcatgacacacagagttcctattcatattctcctgcacggatatccggacgatatttccagactcatactggaaggaattcagtcagatcagatcctgattgatgtgattgtacgaccagaccgatcctcatgggagaagttcccggatgctgcctgcatcctcgtaggtaatgaacctgatgagacggatctctcttccacaatacaggagattaggacatactggcaaactgcagccgtactctcttgttccactgagccataccggcatgatcttctccccctagttgatggatggttcaggatagacactatatcttcatcatggagagagaaccttaccgctctaatcatgacatcagttcagaacaggagacagatacatcatcatcagatccaggatcagatataccagaagatcttttccgaaaacaccatcccgatgagccttaccgatcccgataccggtgaatttatcgaagtcaaccaggcttttgtgcaggcactcgggtaccagcgtgaagaggtcattgggaagacctcccttgacctgaatatcttcaaagatccagaagaccgcaggaagattgtaagcgggcttcatgaacaggcatctcccagggaaaaagagatcgtgatcaggagaaaggatgggagttatatcaccggttatttctcagtctgctccctgaaccggagtggaaaaccagttcttctcaccaccatgcatgatatcacctatctgaaagaggtggaggcatccctctcagcacgaaaccagtgcattcaggagatcttatccagtgtcagtgaagggattgtggtttatgataccaagctccgataccgggtctggaaccggttcatggaacatctaaccggtattccggaagaggaagtgctgggaaaaccagccctgaattttcttcccctgctgaaaggagatgatctccatggccttcttgaaaaagctctgaagggatgtgaatctctctcacaggatgtatggtaccagattcccacaaccggtaagagtggatgggtttcgatcatttacacgccgttccgcgattccagcggggagattatcggcgttatcgcttcggtcagggatatcagcgaacggaaaacggcagaggatgagattcgttcacataaaggcctcctccgctcaattattgacacggtcccggtatccatcatctgctttgatgaagaaggacggattcttcttgcaaataccagtttcagttcatccttcggtctgaaacccgaagcaatagaggggcatagctatgaggatttctgtcaggataccaggtttgagcgtcatatgcccctgataacccgtgcattacgtggccgtgaagtcccattcaatgaagagattgagcttcctgatgagagtccgaaaaaacggtttttaagagggagatattctccactcaaaggaaccaacggaagtatcaatggcgttgttgctgttatcattgacatcaccgacctcaaatccgcacaagcatcagttgaattggtgaatgcgaaactacatctcctctcatcgattaccaggcatgatatcctgaatagtctgaccggagttcttgggtacctgacctatgcagaggaagaggagaatgcgcagcaacgtgcccagtatatcaaaaaagcacatcaggttgccctgctcattcaggaacagatcgaatttaccagggattaccaggatcttggggtgaaggaaccattgtggcagaatgcgggccgtgttttcttaaccgctatatcaggcctgaaaatgggtgatatccaggtggatattcagctgaacgatctttttgtgtatgctgaccccctcctcgagcgggtgatcttcaatattgtggataatgcactcagatatggtggaacgatcaccagaataacgtcgtactggttccagaccggtgcagatgtcacctgggttatcagggacgacggcgttggaatttcagcgactatgaaagagagaatattcaggaaaggggtcggaaagaacaccggtcttgggttattcctgactcgtgagattctggatattaccgggctcgcgataactgagaccggtacggagggtgagggagcggtgtttgagatcagaattcctgacggtgcatggaagcagaaggaaccagaaatcggctaatttttctttgtatcagagattgttatttcatgaattatttatctttgaacttcaaagaatagaggacttattgcggaagatgaaatattgaagtccatacgagtaccccggagaataaaaaacggggatgaaccctatatcctgtctccaaaaaatgattttttgttcaggctgctctttggtgatgacgggaatgaagaacttctcgcatcgcttcttagttccatcctgcatgaggagattgaacatgtcgtgataaaaaatccatatatccttaaattattttcagaggataaagaggccattcttgacattaaagcggctattaattcaaaaaaactggttgatattgagattcaactctggaactcaccttgtctgatgagcaggatcctcttctattgggcacggttgtatgcatcgcagataaaacagggaaatgattatactgttcttcaaaaaacgacgtccattcttatattagatgatcttaaccattcatccgaagattatcatgcatgttcacatttgcatgattggaaacagcacataacactgactgatatgatagaggtacatgtcctggagctgccaaaactacataacctgaaacagctagataaaagtaatactctcctgcaatggatgttattttttaatgcacaaacaagggaggaattaatcatggtatctgaagcaaacccggtaattaagaaagcaactgatctcctcattacgatgagcagggatgaggagacaagacagatgtacgaggcgagagaagaatatctcctgggaagacaaattgaaattcagggtgcgaaaggagagggaagagaagaaggaagggaaactgaaagaaaagatattgcgatgagattaattgaagaaggaatgaatgacgaatttattaaaaaaattacagggcttgatattgcagtgattcgttcattgcataataatagataataaccggtttccctcctaaattctttccttaacttgcgaaagggacgccaattttcataatttatttataattttacccggtacagacaatttttctgagaacttctagcatatgatcgccatacatattgacactgatcatctcattcctccaatgtgtttccctcttttgaacaaaacccattattcagggtaagtgccggattttcggttgaaaacattattttcattcagtgatttttatttcacctcattcatatatcttgaccgcgtagatatgggagcattattctggatgatgatactgaattccatacgagtaccccggagaataaaaaacggggatgaaccctatatcctgtctccaaaaaatgattttttgttcaggctgctctttggtgatgacgggaatgaagaacttctcgcatcgcttcttagttccatcctgcatgaggagattgaacatgtcgtgataaaaaatccatatatccttaaattattttcagaggataaagagaccattcttgacattaaagcggctattaattcaaaaaaactggttgatattgagattcaactctggaactcaccttgtctgatgagcaggatcctattctattgggcacggttgtatgcatcgcagataaaacagggaaatgattatactgttcttcaaaaaacgacgtccattcttatattagatgatcttaaccattcatccgaagattatcatgcatgttcacatttacatgattggaaacagcacataacactgactgatatgatagaggtacatgtcctggagctgccaaaactacataacctgaaacagctagataaaagtaatactctcctgcaatggatgttattttttaatgcacaaacaagggaggaattaatcatggtatctgaagcaaacccggtaattaagaaagcaactgatctcctcattacgatgagcagggatgaggagacaagacagatgtacgaggcgagagaagaatatctcctgggaagacaaattgaaattcagggtgcgaaaggagagggaagagaagaaggaagaatagaaggaagaatagaaggaagggaaactgaaagaaaagatattgcgatgagattaattgaagaaggaatgaatgacgaatttattaaaaaaattacagggcttgatattgcagtgattcgttcattgcataataatagataataaccggtttccctcctaaattctttccttaacttgcgaaagggacgccaattttcataatttatttataattttacccggtacagacaatttttctgagaacttctagcatatgatcgccatacatattgacactgatcatctcattcctccaatgtgtttccctcttttgaataaaacccattattcagggtaagtgccggattttcggttgaaaacattattttcattcagtgatttttatttcacctcattcatatatcttgaccgcgtagatatgggagcattattctggatgatgatacattgacccccaaacgagtaccccggagaattaaaaacggggatgaaccctatatcctgtctccgaagaatgattatgtattcaggtatctgctcggcgaagagggaaacgaggaactcctgacttcactaatcagtgcgattctgggacggaggattacgcatgcaaccatcaaaaacccatatatcctgaaattgtattatgatactaaagaatgcattctggatatcaaagcggagattgatgagaacattctggttgatattgagatgcaactctgcaactcacctgaattaatcaatcgaatccttctgtactggtcacggttgtatgcttcacagatgaaggcaggcgatggataccatgtactcaaaaagacgatttctattctcatccttgacgatgatccatatcacactgacgattttcatgtgtgttcacggataattaattgtgtacagaaatttgaactcactgatcttctagagatacatatcctggaactgccaaaggtacataagagaagagaacaagatacaaatgataaactgataccatggatgaactttctgtatgcacaaacaagggaggaattagatatggcttctgaagcaaacccggttattcgcaaagcaacggatatgctcactgctatgagcagggatgaagaggagagacttagatacgaagcccgagaggagtttttgtttgatcagcaatatgggcttcaagcggcagagagaaaaggaattctcatcaataaacaggaaacagccaggagactaatcaaaaaagggatggatgaccagtttatcagagagattactggtctgaaattggaagaaatctcttctattcgcaacgaaaaagaggtttaacccttttccaaaaaatatcacagaatttctccctttttttggtttgaatttaatgacacacaatatcacatctaaagcgaacccggttattcacaaagcaacggatatgctcatggcgatgagcagggatgaggaggagagactcatatacgaagcacgagaggagtttttgcttgatcagcaatatgggcttcaggcggcggagagaaaggggattattgaaactaaacaggaaacagccaggaaattaatcacaaaaggaatggatgaccaatttatcaaagatatcacagggctggaatttaaagagatctcttcactccgcgatgagaaaaggtttaactctcttccgaaaaataacaacgaattcctcccattatatggtgtgaatatcatgacacacaatatcacatctaaagcaaacccggttattcaaaaagcaacggatatgctcatagcgatgagctgggatgaagaggaaagactcagatacgaagcaagggaggagtttttgctggatcaaaaacattcacttcaggcggcggagaggaccggaattgaaattggagagaaaaaggggatcgagattgaacgaatagctattgctcataacctcataaacctcggtatggatgatgaatttatttcaaaagcgaccggtctccctcctaaagagatccgaaagttacgcaatcaggaataaccaattccccggaaaatatttttcgcccacccttttttcagtctcttccctcttcaagaatccatagaaaccccaacttctcagcccatctcattacctgcttgtcaattcctacatctgtctgatattgagatcccagtacctctcctgaactcctcaaccggattcttctgtactggtcacggctgtatgtttcacagatgaaaacaggcgatgaaagatgtaatcccagtctttgtactgctttcagcacctcaaaccacagagatgtatcgttttctcgctcatcgtgggtgggaaaacaggtgtatgcatgaactgaataacccgaataaatcaatatgctttttttcaattgaagacatggtcagctccggagttgcaggaatccagattaaatcacgagagggacctcattgtcgtggtaccggtaaccccaaaaacggcaccatcagagctttggttgatactatcactaccgggtatccactgtatcgtcctcaattctttcaataatttctgatttgggattgctcattcctgatattattcgctccggatggattttattaccatttctgttccgaaccgggggatacctttctgtatggtcccaatgtggatgaaaaagattattttgcgaaatattcaccaccagggaatacgttcctggctctgaatatcggttttctcatgtagtggggaactgctccattcagtcaggaattactgggaatttccggtatcgtgaaagataacgcttggaatgattggggttaccgggtttcatatcggggtctggtcgagttgtctgattgcagcggggaatgtgagatggtgcgatatgggagatccatactcaaatgggtgattcgacagttaaatttcaataatatgggttttatttctcaaaataaccgggtttgtgtcatgaggatcttatgacttgaatttaacctcatttgggcgatatttttagtaaatattcatgtatattgttttaataacaggccgctattgatcattttgataagaccatggcgggtatagggtacaggtgagatccgggaatagcgtggttctatggtaaagggattgaatatccatttttgagatccatgccaaggatgagaggaggagcaactatggtaattttcagatatctttaggtatttaaagggcaacacggttttttgttaaaaagaataatatttcgaatcttttggaattaccattcatcttctggagggggaaggtaataagaataaatagtttcatgaactttgagagatatatgtagaactatttggggtggggcgtgaaacaagagcaggcgctatcagaggttatcgggtttttgatgatcgtctctctgctagggatactcttctctatgtaccttttgtatgtagtaccaatacagggaagagatgcagagatttctcatatgaaatatatcactcaggaatttatcggattaaaagcggatatcgacgggttaattattaatgataagataaaccttccaattgccagatcatttgaattaggaacgttatcttcagtaggttctggtgctttaagtatcatgccaatgagttcgtatatcgaagcctctgggacattgatggtaaatgagcagaatgatttccttgaagttgttgtgaatggatatgtaggtgatatatcgtttgtatcacctttaccgacagatgttagtaattatacgaaatataatgcccagaggtactataattattatcccgatttaatcaatttttcttgtaagaaaccagatcactgtcctcctgaacctataaattttacaacaaaggatgaaagattttataacattacatcaaaaaaacgaacaacctatgaggacgttttcatcactattaatatgagcaatataactttcacccctacaactacaccgacaatcactccaacaccagaatacatcaatgccacagcactgatcagatatccaaataaaaaggaaatctatgacatcgtattagagataatggataatagaactgatcattatcgtgaatggattagtgaaagaactcttgtggaaaatattacattgaatgagacttatggcacaaattttacaattaatatattaaatgatataatatcgaataatacatcacaattttacgatttttattactcaaatgtccagtcaacaacaatggatccatcaaaaaatttatcaaattataaaaatgccacaatcactaacaaaaataattattatccccctagaattggctccctccaatatgaatctgcgaacaggtattgggtaaatcaaaatttactctatgaaatgggaggtttatttttaaatcaaccatccgatcagggttcatcagtaatgttggttccatcaattgcaataacaccaataaaaaacccccccagtgaggagtattacttaaaagtaagtattaacaacattcggataacagatacagaagatattagcggttcagtcagtgctcagatctttactaaagttgatcaaattcatcacaatatatttaatggaacgattgaactaacaggttttggaactaaaccaaccgatggatcaatacaatattataaattaaaagaagcaaatgaacctaacgcccatgcaatatggcttcaattcatcccagatgatccacgagtaacaagtccaaattctgctccaacaggaacattaacaccagatgatgaaaaccgaatgataacttcaacagaattatggaaaagagggtttgatcaaattaaaactattactaataaaacgatatctgacaatccggatattggaggatttagtggatatatctacacttttcgaatagaagataaagcaaagcagaattattccgcaaatttaattattggtgaaaaagccggtcaagagctacccaaaggtggaaaatgcacacaaacaacatatgatagcgatacatgtctagaggcagttcggaattatataaataacgcccatttgactgaaaaaccatttattctggattacacagaatctgaagtctcccttgtcatgcagagtggggcactctaatggtatatgaccatgctatttcagaaatcatcggggccattgcactcatgggcatcattgtcgcagcctttggtattttctctgctatttatctgcccatgatcaaaccgattcagatcccacaagtaaaattaagtgttgcatgcagtgaaaatataaataattttgatccggagtttccatgtacacagggctcttttagttgtcatccaattcatgatccgtttgataaagaaaaatgtgaagaggattgcaaactccggaattatttcaaaaataagcaatatcaatcaggcgattcttcaagtgaagtattaagatgtatggaacattgccttgctccaatgtgttcaaatcttgcagaatgtggagtaatctacatctgccataacggaggtgattctcttgatattgatagcatgaaaattttggtaaatggattaaatgttgagagtaccaaatgggaaaaaaaagaaatatcaagtaatgaatttaaaccatataattcttacgataaaaattttagtattggtacagtgttaaggattcaaaatcccccatcaccagtagatcgagtgatggtagtatacaatttaccctcagaaaacgaaataacattggtcctgaaccaatttgggactgatgtgaattaacttccataaaataactaaaatataaacttaaaatttggtttaatttgatatttttacaattagcgtatgcgtaattaatgaaattacttttaactcaagctaaatattctcaaaatatgcgagatactgaatttttcggacaattttacacatatatttgattgcctataaacgattttttgatatcttaggaaacatatatattcttatatgacaaccactctgtctgtcatatgggggtatgacaatgaggcacgaaatcgcagtatcagaagttattggagcggttcttctgataggcgtcgttatgttaagcatggcaattatcggggtgattatgctctcaacaccgccacctgaaaaaacgccaaaggcatcacttacatcatactgtgtgaagtgtgatttggatggaaattatgaaataattctctatcatggtgggggagaatcattttcgcagaatcaggtgaaatttatcctttatttagaagatggaagttcaaaagaaatttttccatggtgggtatatgaagggacacctgaagattgtatgttttcggacattggtgatagcagtttatcatcaagagatttttggaattcgattccggaatggaaaagtgggcaaacattaaggtttagggagaaggttttatctaaaccaattggaatggagattcggcactacccattcagatcagccatggtcaaagtagattttaaggaccagatcaaaaacgccccctgtgtcgaaaataacgagtctgcgtcatgtaaagatcccactggagaattaattccggttcttattaatccaagaaaaaagggtgatcctggctgtaatcctgccgggtgtgatgatggctcatgttatgcatgttttacgtattccatgcatgatgattcaacaaaaccgtattattttgaggttcaagccgaaagaccattaaaaccatggaactactttattggcaataatagtgcagttacacatacaaattttagcaacaacggaagtatgaaagatgttattaatgtaacttttttcaataaagttcaatggtggcttggaagaacaaaaagtgagattgcaagatgtgactaaaaatgatgaaggataatggattatcagaaattattggagcattgatactggttgcattggtcatcacaggaatcgggataattggagttgtattattatcaacccctcctccagtatcaaaagaaaaagtggttcttagctcttcctgtatgcaatgtgacacaaattccttcatcatcgtaacccgtcatgaaggaggtgacgttatcgatcctcaaaaaatgaagttttatttatcaacagaatattttaatcggacatttaaggaaagatttgaaatcgcacctacctggttttacccagcagagatttattcttcaatggataaggtaaaaatttgctccccgggtgatgattataatcttacctacaaatataatgaaaatgtaaaaagcatgaaaaacggagatgtgattgtatcctggtatgttatgaaaaagaattgataattaggtgatttgtatgaacaaaaatgtgattttaagtgttatcattataattgcggcagtatttatgtgctttactatcgcatatgcagaagtaaatgtaacaaacaaaggagagggaaaacctaaagcgttagatatttacattggtgaattcccctatagttcctcaattggaggaaacatcacttctgcctctaaagaagaggtacctaacgaatttaaagtaataaaggacgaccaaaaatttgatgaaccaagctggtttaacgacactgctccagaggttccaattactccaacaccgacagcaactgaggtcattcctgtagacttgggtggcgtaggagcatctgtttgtgttatggatgacacgaccccagtaattgttgattttgcatactcatcggctggatataaaaatgtattcaaactatcagatccgaaggtaattgatttaggctggtcacaaggggaaatgccaaatggtcgaactgggacaccatttggaactaattggagtcttggcacattccctattgggacagaattaatcttttctgatacagcaaatgggaaaacatatttcacaggtcctgcatcaagaaatcctgataagttagctcatgcagcgattacctttaaaaacagtggcacacatcatcgataccttgtgagttttgaagatttctggaatgggggagataaagactataatgatttagagttttacctcagtggtaatttatctacaggatgtacacaaggtggagatacaggaagtggagcacttattcccatatataccggcaccgtatgtaagtgtaattcaaaatataaagatggaaataagtatacatgcgtcgcacaatttacctataatagttctgcaaataatattgtaattccagttcatgaatccagtcttccatggaacgaattcactggctcaggaatggttgagcaataccggtgtcagccgacaacattctatatagatgctcataatgctccattttggacaaatagattctggaataatattaagtggaaattagggcatgatcaaagtgtattggtgaaatgtgaagagtcgacaccatcctgtgaatcacttggatacaatagtgatgttgtgtgtgttgattgtaaaagcaataataataaaagataattttcacatctatctcctctttttttgaattgtttaatcagagtcagttctataaatttcatgatgaaaacattaaaaaaaggtaattattatatttcaactctgaaataatgaagtatacaaaaatcatataattagatcttttttctgcaagtttgactcaaccaatttttaattaattgactcaaaaaacgtttttgttaattatgtaaaattattcactcatattctggaaatctacaattttttgctataaagaaatattgattacactaatgacataactccagaatctgtattcatgataagatccagatacaaaacagtatatcatagcaatcataaaagatctaatagatgtgaaatacatctgaatatagtaacagcacctaaatccccatttcaacgacatctcttgaatacaatagtataatcaaattcacaaataaaaaccaaacaacctttccagaattttccagataaaaaactcaaacaccatccccctccaaaagaacatctcatgacttccattcaaacccctgtagaaaaacccacagataataaaaaaccagcaaatctccttccaattaccgaaaaatcagataggattagcttaaccccggccatcatgacctctcttgatcctggtgtgcatgtgtgcagatccacatccattgtttataccggaacaaatgacacgagccatcggcatcatacccgcagccacgacaaccacattgaccagatctcacctctatcccacaccctttggggtcattcacccggcaaactcaatgagaatagtatgacctccaccattcacacacaccagacaagatctcacatccaatccaaaaactatcccaccagaaaaggaaatcccatgaccaccattcagatacccaataaaaccccggatattaaaagaccagcaggtctccttccaaggaccaggaaatctgatcggaggagcagaagcccacatgtgtatatcactgtcggatactgctatgcatctatgcacacctatgcacgagctatgcacacgaacatgcataacaaagaaggtcatggttcagatggtttctaaaaatatgaatacatgtaagatttcaattctgctatgcacacttcggaaggtgcatgtacacctcaccggaaccataactgagccctcttgtacgatcataaaaagtgtgcatacaatactactaagtcatttaattttagctatttttgaatttataaagaatattaaggttctttgctatgcacacaggtgtgcataaccggtgcatagctgtgcatagtatgcatacacccctgtatatactgggaaagatacagaaaccatgcagtgtggaaattgtggtccctgcatagatctttgtgaagtacggttaaatagagactatttaagccatggacgggatttgcaccagattatatggagaaactcttcggaacgttgtggtattcacaataaaagcagcgagagaattattccaggcataacgaaaattgagatctgacctgccggggccatataccgctgtgaagaatctgggcattgtttccaaacccagtcctgaagatggaaaatacccgctggtttcattagaatacacaatttttattcgattcagtatttgatccttctcctgactcatggagaattaaaaaaatgccggttcacagccatcaccatgtaaaccagtatatcaggtcatacacgtgaggagatttagttacattccccggataaacccgttcctgcggttcgacgatcaaacacgacattgaataggacatgattcattacttccaacacagcattatgggcggtaaatttcggttattcagcgaacacagaatttttaagttaagatattccgaagttcaaagtaaaccaaccagactgcccttttgggatattatgaatacagggatatcaaaatattttttatgacaaaacacaatagaaacatatcagaaataaattgaccatcaattagaaaaattgcgatggcttgattaagagatgattattgtgcaatatgtatggactattcctgaaaattttgataaaaattgaaaatatacagaaaccgcatgaaaaaagatgaaaaaatccgatccttgaaggaaattctgagtcaccggaatgaaattatttcaattgcaaaatcacacggagcagataatatccggatttttggatcatttgtaagaggggaacaaacagaggatagcgatctcgatattcttgcagatattgatgcgagcagaaacctcctcgaccaggtggcactcatcagggaactggaagacttccttcaaataaaaattgacattgttgaaccggagtgtcttcactggtatattaaagataagattcttcatgaggcaatatccctatgaaggatgatagatattatctcatcctgattgatgaatatattaaaaaaaattcgtgaatacacaaaggacggatatgaatattttttatccgatgacaagactcaggatgcagtgatcagaaaactacaaatcctcgctgaaacaacccagaggctttcagatcacatcaaaaataggaatcacaacatcccatggcaggatattgcttgtttaagaaatattcttgttcatcagtataccgaagtaaatgtaaccagaaacaggaaaagttggcaacaactcttttaaaaagggtcgggcttgacccgatctaactctttgaaaaactatctatgagtgataagatatttgaaagacgaaacctatacttccatagtttttataaagaaatatataaatttgggagttttctgagattcaatgtcggaatgccaatataccagccctttatttgatattgccatattgatgaaaatgattatgagatcacaagcttactattatacaactttacagggtaatacaactgtataaggacaccccccatacgtttgcgagaaggttgtcataatacataatctggaatagagaatcgaaacatgaaattgatagaaatcggagatagaaataatgacagcacatacacagaaacaggctcaggtagctagtaagcgggtagctctcacaccggatacatgggtggcactttcaaatattaaagaaccagggaagacccttggtgatactgtcgctgatcttattgctgaacaccaaaggcggactctcgaaatggatcttgatgagattagtaaaaatggcaccttcacttcatgggaagaggcaaaaagagaactcaagctgtagacgaggttctttgtgcagatcagaatagaagatcgagcaaaagagtttatccgtgggcttcctgaaaaggatcgacgtatcattggtgaacatatcgaagagctcatccaccatccacatgcccggtggaatatcaagaggttaaaaacgaaaaaacctcactggcgtatgcatatatcatggaaatatacgttgttctattcaattgatgccgatatgattttgatagagaaaatcatgacaattgaacaggctcacaagaaatacgggaagatttaacctatttctgtgcataggcatacccataaatcttcatgctccccctgatcataatcttcaagggtgtcaagtaggacaatcatctggaagcttacattcttattaaaatttaaaattgttagtgaagggttacgatgtactgagcctttccaattatctaaaaaagaaaataagatccggtactgatatgatatagaaaatgaccaaaacccttccagtgatccatgaagaggatgggttttaaatgagacgtgaaatgggtctgctttaaaaattttaagtttttgcatattcctatcaaatcaggatgttttcgtgaccatttctgatatgacttaataaatcgttcattccagactattcgagtcatctaaatctttccataaatcttttattgagccttctttacatgagcccgaataatattcattaagagcttcatgggcttctcgtgctaatttctctcttttctgctcaataagacgtttatgaaggatctcttcgatgtattcctgttcatctgttgataaagaatgaataacttccagaatttgcgatattttcggagtcgcgaccgacataataataatatatcgctatcactctattagttttttgccacacaaaccaaaagcaactacgtgttccactcaaattattcctttacccaacatgagatacttgaaaaatcaatggcgatctaatactctgccactctgttcatatgctgtacaaagtatcaagaatataatccccttggaaagcatcaggtcagcatacaccatgagccctgacactaccggagaggacgaaaccagaatcaggaaaccggtaatattcagctcacgaaacaccactccaataagaatgcaccgtggagattcagcccccatctcatcatgcaaccttggaaaggagttaatatcctctttcaatgtatcacaggtaaaagctttctccgatccataacccacattcgccagatcttttttcaacaatagaatttttcgtactccggcccaagcaatcgcaatatcttcaatagttctcgatccaaattctggatagatgaatggagtgcatcattgacagaaataatacatgacttaatctctctgaatttaaaaaaaatccatttgagcgttggacgagaggtaggtttcttcttctgattcaacaccgtttcatcttcttctttcagcctttttcgcagcagcatttcagtatatgagtaaaccatgaggcagagaaccataaccatacataaagcctcgatccttttttcacttttcagataaacttcagcaacccggaatgatttgtcctttaaaaaccggaaacctttttcgacaagcatctgtcctttatagtgattcagaaccgtttcagaatccaaactcaaaacattcgttgcaagaataaatctgcccagatactgtttttcactttcaacgaaatcctgagcaagttcaacccttgcatcgatcgaatattgtgggattaacgtttctcctgcttttgggcgccccttcttaccattttcccgtttataactgaccttgatccttgaatccaccaattttactaaaggtgtttcattaagatagcgtaagagagcgttattggcatctgtttcacatgcatagcatactttagaaatctgttttaacccttttaatgcggctttgaacctcacagggaggtttttctcaaacgtcttcaattctcgagctttcatctcttcagatgagacaacaatccatttttgaggaacaccaccataatgtgagtcaacgctactgcaagaataccgtggatctgaggtaggagtgaagagaagatcagatttgagtaactctgtcatctcatttattgtggctgggacatttgatatccaccttgtttccggaccgagggttttgatgtttttatcagtatacagggcactgtcacccatgaagattacatcaggatcaaatgtgaatgaatcttgcaatgataggattgtttgcacaagaacttccttatctgattcgttgccatcgtgtgcacgagcaaaaatcggtatcccgtgttggttaaccaccatacttaaggcaaatctgtttaaatcccagcgtttgtcttttggatgtccctttgtaattttgatacatccatctccggattcatttccatattcaccatgaacactgaaattggttgtatcaacatgacaaagctgtactccatctttgtaaacagtaaacatctgggtgacaagatcagtaaagagcttgctggggccatatgcatatatcttatccaaaaggcgaccaatgactgattcatttagattttttgcagaaatatccggacctatgagacgttccaaatcaagatgcttgcagtattcgggaaaaagatagagtcgtctctctgtgaatccaagtccgttgagaatgagggctaataaaatttgagaacttgatatttgatgttgaccaattttagggattgcccggtcaattataggagctaaaccaagcttatggaacgtgcctgcaactattccaagatgatcaatggtttttatggagtctatttctaatgaaacatcctcatctttcattaattatagtaatggagatcttcttagttatatagtttactattatataaaattttaatagatctgacgaatataggcataatcaggccagattatgccctctggagaatcctaattagataacaaccagtatatagcgtaaaaaatttgtagtgcattaataatgacagcgaaaaacaatactcgtacagatccgaatgctggaacaaatgctacgaaccatagattctcttctggaccagagggtgtaccagccggcagatgtaataatgtttggagtgaggagacaaggtaaccagaatatggttgattattgagcaggaccttccagatttatatcattttgtgaaagaacaactgaatgatactctgacacaatcccataaataagggttaccaaaaacaatcaaaccctgtattatgaggcatccggtgtgtaatgttatgtgtttattccagaacgatttgcttcctatttacaaaaattatctgaaattttcattgaaaggaaaaagtttcaaataacatatcctggaataatctttatctctggatgcaaataaagtaattttttgttcgatacttgtagctgcaataacagcgtcagcgggaaatagcccataatcaaccataagttgcataatatgatccgtatctgcagaatcccggtgaatagtcatatttccaaaaagaagagaaaccttctcataaaaatcatctgcaaaagaatgcccattttttataatgtattcttttaaatcaatatatgaacggatttttaacctttcgacggcaataagtctcatcccaataaatagggtctcctgatagaccatcgagcacgtatgaaatgatccatggaagttttcaaagaaacctcttacctccatagttgcaggagattcaataagaaaaggaataattacagatgtatctataaagatgtccacgactctctccgcaatgactggataatatcatcagtaaccggagtctgtagtacaataggatctaaagaaatatgacgctctatatgaagagttaatcgttcaccttttttcagatcaattttttccagaggacggaatacttctccatcataaatgcaatcaatcgtcacagtcattatttcttacctataacgtaaatcagtatatgtaattgctatactaataactttttttgaatttttcatgaatatgcaatatttgccagaatcgaatcacgcatttctggctttagggcagatactgtagtaacatcaacagaaaccccaaatatggactccagttttatttttaatccagataaatcccatatatcagctccgggttcaaactctgcaaggatgtcgatatcactgtgctcatgagctgacccagatgcataagagccaaataaacccagacgttttactttatatacggtccggaattcaggagagagttcacgaatcgttttgagaatgagatccttgttaagaggaggttgatcaaccaagatgttcacctgtaccttattcatacaatactctctatgaattgaaaagtttttactgccatttgaaaacctaaggcctataatcccctttccggaaccaccatctcaaacctaaaaccattcaacaattgttattcaaattcacttcttgggagatcggactgacgaattatggatagcaatgtacccacccttatctcatcatgatttggaaccggaacagtgattgttgaatcaacaagtcttttttgcataacaatatggcttccccgccgatggacctcacaaaagccatgtgtagaaaggattatacaaacttcttttccggagagaatacggagtttacccaattgcaacctccagactagtcacatatacttcctggtgtaatcgggtctgaatttcaaattgggatgcagtttcaaaaaacaattcaattgcctctcggagattattacgggcatcctcaactgaatccccctgacttgcgatatccaattcaggacataatgatacatatccatctccttcacgttcaataattgctgtaagttgttttatcatactattatctcctgaataaattgggcagttattctatctcctatagaaattttatgcaatatatgaacttctatcgtcagatgacaactcaattttcatgaatttcaggtgacacattctttgagacatatgggttttagaacaatattaacatggcaccaacacatacataccgtatggtttctttctttggtgatagagacaatttgtatgctgttggtgacgggttcgacctcatcggcggcaaactttcagacattacaatagcggatatctatgaagagatcacgaacctggaaaaggagcacccggatgattatcgtatcctgctgacacgtgaattattactcaccctcctgggagaccatgaagaggcaatacacctcctgaaggaaatagatgacctgaaaaaaagcccgttctctcaattcaggatagccaggcatcttggagcactcggaaaacatgaggagatgaacaatctcctcgctaggctcatcacaaaacaggatactccaggcgatcagttgattgcgttcctcgctgcgggaacacttgataagaaaagcgaagcagtatacctgtggaataaaataattcaaaccgaagaccttgttgatctcatcattgatgacgatgtcctggaatacccggatgatttttcatgcctcctttctttgcccattggcttctctgtaatcggacttgagatccttcaaaaatataatatccgggagaattatgaggtagagatctatgcatttgtgtatttcatcaaaataatactggactccataaccgatcatatctatcagacactgaccgatgaaggaccatatgaagcgttgccagggtttattgtagccgaagcaattgctgatgaaggatattcccttgcatcaaaatttttctccttcactccgattcataatactgcaatagatttacacatacataccaatctcaatgaaataaaaaaatacacgtcagaatattccatcggaaagaaactcatagaatcactccataccgatgccatacatgacccgcaatttctctctcatttacgggaagagaccggaggaaatgagtgtcagatatttgaaatgctgctccatctcaggaatacaggactttcagatctcataatgcccctgattgaggagatggaaaaaagttatccaaatattcggatggaaacccgtgaacagtcccggatgatgaatgcattatgggattataccatggaagggagatactcaagaaataatccggaagataatcttcaggatacactcaaacaattgtgggaaaaaggagataatacagaaacgtttgagttcctgtccgggcatatacgagcaggcagacttctctctgaatcctcctgggcattttttctggcaggaaaactcggaagaattgatgagctgacagatttacttcccatgtataaagagaagaagatgaacgaaattgtatatctcctggaaggatatcagcatctcatgcacaaggacctcaaaccgggtctgaacctgattgagagatcagttcaggcagggctgtatgaaccaattgccatggtacttcttgcacgattcctgaacaaagcaggatatccaaaacggacgatcggaatctgtgaaaaactgctgaaaaaatcatttctgaaagctactgaagtgtatcctatcctggttgaagcatatcggatgcaggggaaagaaaaggaagcagcagcagttgaagagagatataaagactgcttgtgagttagtatttctaataaatcaccttaaacccatttttgctcaagataccatttgttgtccagggctgtacttatcgtttttaatcctggaagaaactaaattggataaccagatatgatctatcaacaaaaagaaaatttatctcattctgacacgatatgataatcatgctcgctgaagggagaatcgcatcttcggccaaaaaaatactaaatgtggaggaaccctcacgaattattctctttggctcatatgccagaggtgatgcaaccgaagattcagatattgatattcttgttcttgtgaataatcctgagaacagagggagaaaaatggttgagtatcggaatgcaataggaagggtcgctccaggtatcggggtagatattcttgtatacagcgaagaagaggcattaaatccagtaccaggaactgtgttatactgggcattacgtgaaggaaaagtgttgtatgaatcaaaaaattgagagtcaacggttttctgaaacccttccaatatactttgcttccctgtccgaatcccagaaatatcgaatatttccataatcaaaagctacaaaagacccgaattctttttgtgcccattttcctcatatacccgacaatactcattatcagccggatatccgaacctccatcatcatgttcccatgtccgagtcgaataaccacagcgaacaacgatcaatacttatcggaatgtaattggcaaaaacctgacgcttactattaattcgggtaaaaaagatagcattcatctctgaatcaataattggatgaattatactcaagaagtaattggaaaaaccttcctacttaaaaaagtgtctgcaaatatcaaataattttttaaaactatacaaccctgattactccttatttagctgtccttttttagaagttccatggatataatgatcatgctctgatgaccaatcaggagggccctctatgatcccggtatacttatctaatactgcccagagatcttctgatttttcaggttcgttgataattattgaaagaataacatcagtaccatccttgagatcaatcttgtcaataggttcgaaaacagaagcggtaaaatgtgcacggatcgtctttattataatctaatattatccattaattcattaatccgtttataatttctcatgaaaccgtcaatttaacccaagaatttttaattgtcaccagagaagtatatgaagttatgacaatcgatatcccccctccggaattaccatctcaaacctgacacccttcccatataccccgcattccctgatccgaatcccggtaatatccagaacctcccggatcaaaaataacccaagacctgaattcttcccatgtccctggctgaatacgatctccttctcatcatcaggaattccctgcccattatcttcatataccagacaatactccagaccggcaggatatccggacacccggacgtttgtcaccccatccccatgtcggaaggaattatcaagaagattgtaaaacacccgggagaacatcaggtcagcatacaccatgagccctgaaacctcaagagaaaataaaatcggtgcaagaagacgggcaatatcaggctcttcaaacaccgattcgaccgatatccactttggtgcttcggtccccatatcctcatacaccccggtaaaggagatgatctccccgattgtatctccggcatgcactattttatcaagcgattcagtatccggctcatctcctgactcctgaagaatccgggcatagccattcacgaccgtcacccagttcaggacatcatgcctagtgatactcgtgagaagattcagtttcttatttgccagacgaagactcgtttccgcaagccggcgttcagaaacctcatgggcaagatcaaggttcatcttttccagttcttcattcctggcagaaagttcctgctttgatcgttcccggtcggtaacatcgatacagagaaggagccgtccacaccctttttcaggcattctcttccggttcaccggggaaacccgaaactcaatccaccggtcaccaatatgggacagccggtttctcccatctgaacaagacgaccattcatctccacaatcaggaaagaggggtgagagatatgagacatgctttcccacaacaccggaagtcaccgggaggaggagcatagcagcaggattcaattccactatccggtcctgttcatcgatcacaatcaccccttcctgcatatccatgatgatctgctcatgagcaatcggaatcagatcaaagagcaggtgccgggtaattgcatagatgaggaccaggccggtcagggtaaatgatatgggagtaaaatcaattccaaagaatattggtgaggcaaacgcatagagcagacttgagatgacaggaaagagcgaactgacaaataccagccacatctgaacggcatataccggggctgaccgtatcacagcatgaagcagcacaccggcagcggcaaaatacagcaggagactatagatgatctccacccagtaccaggccccatgaacataaaagagagagaacccggccagaatagtatcgacaaggtaaatcttaggccagacgagaccatgaattgggaaggttgcagaaagaatgaaactgattaccggaatgatcaatagaagatatacggccttctttggaatccggtctccattccgggtgaactgaaggacaaaataaagaaagaggaccggcactaccaggtcgatcaccgatactaccgaccagaataatttatacccaatcgaggttgagatcgcttcaaagaaagaggtgcatgaccagcagaagacaccgatcataagatacaaaaatgcccgcatgaccttgtcagatgggcgatgagatgcataaccagccagggcaactgatatcagagaggataggagaagaaggccggcatagagtgaaaactgcatatattatccgagttatttcaggtacggtatgagatagctcacatattttccctgataaaatattaagtgcttctgggacctgattttttacccgcatgactggatgaatgtccgggtaaatcccgaataattcagaaaatttcagataaattctggtgaatgattacattacggctgcattatccacagcaaaattcgaaggtattgaagagaaagaaccatattatggtgaaataccttcattacccggtttctggtcaacaggtgattcacttaaagagtgtaaaaaagtccttctttctgtcgtgaaagaatggattgccctttggatacgatttggataaattaccttccacacatggataattatatctgaccttctcccctgttttatcgatttagagaaaaaacaatacgatcaaacggtaatatatattgagatgagattatccgaaggtgaggtatcgctcattaaaaaaacgatatattcgtttgatccctccgcccgggttatcctttttggttcaaggacagatgattctcagaaaggaggggatatagacctcttcatcatttcaaacaaaatttcaggaattgaaaaacgtaatatccgaatcgcacttgaagataatctgggcgaacaaaagatcgatatccttattgaaccagaaccaaaaactcccttcgcacgaattgccatgagagagggaattgaactatgaaccagactgatgctcttgatcttcttattcagacagatacgtacctgcaggagagcaaagaatggctcttgcattcatatcagatatgctcaggaattgggaaaaaatcagcatactccattgaagagatggacgcattcgaagcgttgagtagcagatttgcccgttcgagtgatattctcatccagcagatgtttcgaacgattggggtggtggaacttgagccaggcgggagtgttctggaccggattaaccgggcagaaaagatgggttatattgaatctgcacatgatgtacggacaatcagggagatcagaaataccatcgtgcatgaataccagcatagcgagattattcaattatttcatgatctgctggatacaactccgatacttcttgaatctattgaatcgacacatgcctatatcgcacgatatcaggagaagtaattcagcccctatactgaattcaataatcgaatcattacccggattcgtgatccatagacgcctctcttgccatatggacgattcgctttacggatgaatacccgatttttgtcccggactctgtaatctgctgatgaacgccaatctctgaaaaatcccctttgaaaacgataaactggttatgacgtgcggttgggtttttccctatccaggtatgaccaaagagttcctcaaatctcttttcttgtgcacgatcatagtaatagtgaagcattgaacagaaaagggattttccaaaccgacgtggcctgagaaaaaccgggttgtgaatctcctcaagtttcgcgataaaccgggtcttgtctacaaaatacgcattatccctgaccagttctgcatagttcatgattccatacgggatagggcgtttcacctgactcccccgatttctgaattcgatatcgatcttctggtaatatatgtcaatgaaccataaaaccctgtggtacataacctatacattcatatcctctcctgcagaggatctctcatgcaacggtatccaatcatgcccgttcccccacatcacacccttcggattgcaggcattctcgccatcctgtatctcattagcttttttttcatcccgaccgccgctgatgaccaggcattcgggcctgtaaaatttcacatccttgcagtaaacgactttcacggacaactcggccctggacagaagatgaatggatctccggcagggagtatcccggttcttgctggatatctctctgatgcaatcgatacctacggaacaaataccaccataattgcccttcctggtgacatgaccggagcatcgccggcagaatcaaatctgcttctcgatgaaccggcaatactctttatgaaccggtttgtaaccggcgactggaagaaaccagacacaacagagacaacgggagtcagagtcattggaacccttggcaaccatgaatttgatcgcaacctctccgaattacagcggctcataaacggaggcaatgatgggacgaacattacgcaccttgtagatccctatcccggagcactctggccggtcattgctgcaaatatcttctggaatggaacagacaacctcttccttgagccatatgtaatagaggacatagagggcgtcccggtcgccttcatcggggctgtcacggagctaaccggtgagatatctgaacctggaaatgtcgaacaagtcgccttcaccgatgaagcagatgccatcaatgcccaggtgaaggtgcttcaggaacagggtattcatgcatttgtcgttctccttcatgaaggaggaagccagacaccctatgatggtccgacacaggagaccggggatctctcaggcagggttacgtcgattgtgatgagactggatgaggatgtcgacgtggtcttatcagcccattctcatcaattcaccaaccagtacgtgccaaatgccggcgggaaaccgacccttgttacgcaggcatattcatatagctcggcctatgctgatgtaacccttgagttggacccagaaatgaaggatattgtgaacaagacggcaaccattgtcaccgcatatgctgaccagggggcaggatttacgccggatgaaaactcccaggaattgctcgatgcagtaaacagcaccattgcacctcttattagtgaagttattgcgacaacagacatcccccttaccaggaatccggatgagaatggagaatcactgctctacgatatcgcaaccgatgcattccgatgggatatgaagacaaacattagcatcctgaatatcggatatcttcgtgcagacatcgatgctggtgagataacaaccggcgatgcctactcagtcatgccattccatgaccagatctactcagtacaaatgaccgggcagcagatcaaagacctgctcaatcaacagtggacccgtacggtaaagcctgaccatcttctgcagatatccgggttttcctatttctatgatgaatccagggatccatcagaccgggtagtcaatatcaccattgacggagaggagatggatatgaacgcatattacacggttgcgacaatagacttccttgcccatggaggagacggatataccattatgaaagaagggacacttgttggatatggagcacttgatgtcgacgaatttattgcctatctcacgtatattccgtcaccaattcatgaacagaccggtggaagaatcaaccgggtagatagcggtattgagcaggaatgagatagaaatatcttcactcatctctaccaaaaatttttatccgaaaaattcctcgatgaattcagctaatttttttgagagatgtccctttgtctttcccttctttcctttctttccttttgatggagcaattttcgctggtttttcaaaaaatccgggaaacaacatgacggatatggtttttctcacatattgacgccgtaccctctttacacgaaccagccgtgggaagaagttccctttcatctgttccagtgaggatacccatcgcatctcatcaatgagcgagatatcaaacctcttcaggataagtgcctcaagtgaaaataacggaggaatgatgacaagagcggtagtcatccagggaatacatatcggaagtgagcgtgtataacacaccggcagcaataccatatcaccattccgggctgcaagaattggtatgaatctggcagatatccggagcgggaaggtcatgcagaatggaagaggaataaccgggatcactatccggtcccgctgtacccgtcttcgtttcagatgcctgaccgtatgtactggtgctgacagcagaaacacaactcttgtcggtaatatacagcaccggggacgaggggccaggagaagacgtgcagactgatccggataacagaatggacaaagtccgggatacgtacagaaccagtgatcaggatcagccgggcaggaaacgagggagaggaatgcatgttcagaccgttcaaaccagcaggagaggatatcttcaagtgatccagaacaatcctgcgatcctgaaaagatactcctcatcggaaacggaatccggtcaggagaaggaacagagaaccgatatcgggctcttctattaaagacctgagcgggatcacatccgtccatcatcatgttacagagaagggttctgatctcggaaagcagggaccttctatcttcttcatcggtcctcacctgctcctgcgatactgcaagaacccgaactgaactgtccggaccgacaaagacagaacggggggacaggctgaatggagagagtcccacccgactcatggagagaagagcggagagaagatttgtgcatgctgcaacccggtacctgaatgaaaacttttctcctctccacgatgtgcgggtttcaggatctgctgcctcgtgccaatgaacgtaccggctgaaatcaatatcaggaataagataatgtatccgtttttcaggcccctggttctggtagaccattttttccgggactatcaccgatggcggtacctgactaaccgggcatgataacagaggagtgaggcggttcatgctgataaggagctgaaacccgtcacggtcggtttttcgaatctccccatgagaaatgcgaacaattctgtctccgacatcaagcgaacatccctcatcgtcgatatagtccggtacaatcggttttgttggtaccaatactgattcaggcgttgtttttatttccgaacccgtcacccgtatcagaactttcgggtctgcagcaagtctgccatcatatgaaaatcccagaacctgtgcccatcgtgagggttcgggacgggcctgcgggtgctggtgaccggtcacaaatgcctcatgaaacagggcacggaccgatgacggaatccggtcgtagggcggggcatagtcaggaggatacaatcctggtatctttccttcatacgcaaataggccacgaataatcttatccggagtggtgggtgcatcctcgatgagcggtccccgtccctggtacgggtgggctccctgcatcaggaacctgaagataaggacggcaagggcaaaccggtcagcaaagagccggtcaatatcctgcttctcaaacgatccgtctatcagttcgggaggcaggtattctcctgtcccgacccggcagaaccatgtccgtgaggatgacgggtctgttatctgaaaagaatcggtatcgatgagacatatctctccgctcgtgctgataaaaacattattctcacgaagatcgccaacacagtgtccggatgcatggaccgcatggacaagactggcaagtcgtgctgctgccttcattgagaaggaaaaatcctggtcaggtttatcataccaggcatgcaccggcataaatctgctatcaaggcgggtcatcaggtatccaagaaaccgtgagggagcctgtgagaggatgatacccgacggccagcagatccccgtaccggcaggaatccggatcggactcttctgcatgatccggatcttctcttccatctcaggactgcttcggtgcggatgaaatatcttcacacaccgtgtttcatcaccttccacataccatatctccccttcgccgccggattttccggatgatagtatctgcagctgaccaccatgctgatcaaggacagtcattcgtgatctggtctttattctgggaagacggatccgtgctttctcctgtgccagatatgaacgtgagatctcgatattcagcgtgaatggcccgacattggtgatgatcaccagctgaactgatgctggaacatgtcccggtagcaggcgtgtatccactctgatcgtaaccatggtgctgtcggtgacggagaatattgacggaattgcggttatccagggatattttgaaggaatagttccccgaagggttcctgctccggtgttcttcacgataagacgctcttcgatgataccccggacagtccaggatatgcgaagtgaagatggcataaaccggggaaccggtcctttctcctgtgaacggtgaatggatacctcaaccgtctcctccccgccattcgtctttacatgaatccttccgatcggatgtcgggctttcggggctttcgaagtgataactctgaccgggatgacctgcaccgtccgtgtccagatgccccgggcaggtatctcaatccagtcacagagcggaactgcggttcctgataaaaaaccggagccggcatttctgaccgtcaatgaaaaagagattggttcatctttcgtaataccgcaaaactggaagaccttctcatccatccgaagcgctgatactggtgttggggcttttctgatctcaatctttacccgcccgattccaccggttgagagaatatgaaccgatgactccccacttgccggggctctttcaggccgtatctcaagaattacccgctggataaaggtggtattcagatttgtgtcaagaacagtaacccagtctgcatctgaacggatatttccatacaggcgtccctttccctcgttcatgatgaccagttcttcgcgaaccggacctgatgagagaggagagacctctattacggtacggtcaatccggatttttggttctgatccggacgacccggtcatcagaagggctcaccagacagggagaatccaacggccaacgtcatgtcgtctgatgagagtgcccgcatgcgggaagaagagaggagatcggcaacctcggtattcaggtcccggccttcatgtatgtactggccaagggatctgacaagaggcacaacaaaaggactatatgggatataggcgccatcctcccttcggataagggctccctggcatccgtcggttgcacagatgatcgcatcggctgctcgatgtgagatgcgacattgtgactcccagttctgtgcggtcaggacagcagtctcattggcatactcggcagttccgggaaccgagagcagggatggttcgccttctgaaagggtgacacaggctccgtccccgatatgaccacagaaggcgccatccggggtgagaaaagccaaaagcagcgtcgttgcgaaggatgagatgtccagtccttcagaaagggcatgatcatcaatatcctccctcccggcactcatggctgacctgataagagcagcaatgtccggctcaccggccttatatccatctgcggcatttttgacactggaagatacggcaatatcggcaccttttcctccatgttctgcggatgagagaccatcagcaaccgcgatgatgagagcaccggggaggatgacaccggcccaggcatcttcacatggtatctgatcccgaatatgcctggttcctgcgaccgaagcaccacaggcaaaatacgatccgggtctggcatgtccggcagacattgatatcagagctgaattactccccagccttcaggaccaaccgggttctctagtgatatctgttcaccaatccgggagtctgatatctgggagagactctttgaaagccagaggaacatctcggcccatttcgcttccttgagcatgagcggggtcctgcccggaggagatatctcacggagcaccgtcatattggcctggtcaacaccaagcgcccagaagaggaatttgtgatccctctctcccccatgcaccgcctcaataaccttctcccagatttcgtcacctttgcgcatatctgtcggctgaccgtcggtgattaaaaatatccaggggcggtagtaatcggttccgatggtccggtactcggcctttcgctcttcaacaagccggacagcctcaagaatagcctgacccatgggagtatacccgccggcagagagttccggagggtcaaatgccgatatgccggtgaagggcctgaccagttcaacccctttcccaaaggttatcacggcaagatctatccgttttaccgcaagatcgtcctctttcaattcatcggtgaggatgcgaaggccctcgttcagctctgctatcttattgcctgacatggatgccgatgtgtcaaggaccaggaccgtggcacagtggggatgttgcggataggggatatcaacgatgtcttcaagtttttctaagcccattgattgaaaattggccggtaacttataaaataattatcaaacaataccggttatttgaagtcaggagggagcggtacatagctgtggatctgctccttggtattggaaatgacctcctcggggatgacggtgttggcccttatatcgcaaaagcacttctggattcggactggactgtcatcaatgcaggcattgttccggagaattttatccgtccggtacgagaacgcagaccagaacgaattgtcatcgttgatgccgttcatatgggacttttgcccggtagcatccggatcattccgcacgattctatcagggactatgggattgggacgcatcaactcccccttaccttcttcattgagcagtgtgccccccattcacacgtcacctttatcggaatagagcccggctgcctagatcctgacaccccgctgacacccccggtttcccgtgccgccgctgaacttatcagtctgttgagaactcaccggtatgatcacctgccggtcctgggttttcaggggaagcaggaacaagattgattttagctgcagggtacacgtatacagaataaggggaatgatcatgcaatatgagaatatcgatagcgctgagatggccgaattggccttgtcacaggccgttgatgaacatattgaaaagagcaaagaggcaatagaccggatttcagaactagagcagcagatcctgcactggaatcaggaagatatcagaaaactccgcaatgatattcaggagcttcgggaactcctcaagaaaaacttccaggttcagattgaaaacttcattcatatgcgatccatccccggcatgcgggtacctgaagaaattcgccagctctacaagataatctcggtggataaaaaggggtttgccctctatgggactgaaatggataaaatcgcacatataacaaagatcaccgagcatttcaagaaacgaaaggaagcggcagcacaggcgaaggcaaaagagaagaaataattctcctgtcaggtctggctggcactgtgccgaagaagcgcaatacaccctgttttatcaagcggctggttatcattcccacatttcggtgagtaaatacaggccggacacccgtctttacacctgcattccctgaccatcttctccgccgactcacagagctcttcataaatatgatatgcacgttccgcaagaccgatacccccttcgtacccatcatagatgaagatgaccggttttcccctgacctctccggagctggccgatgacaggccccccagatcccaccggtcacagaggacatggtagggcatcatggcaataagagcatgttctgccccatggagagaaccgccgacatcacgatctgctgacaagatccgcattccttcgagagagaattcaatccagaccgatatggtctcaaaggtaatcggttcaagggagagcagttcggtggagatggtcctctcatctataagccggcgatacccgtgatagagttctgatacctctactctgcccagacagagtgttccggacctgatctcccggctcatcagctgctcacggatctgaacactggtctggtggtttactctggtataataccccggatcctcctgggtcgcaaggatccggtgacggccaaaatcccagctgcctaccagataccgctctccctggtgaataaggaccgcaccaggatgggcctcgcgacatgcctgcctgatatccagcgtctcaataacccggtttctgacctccaccgtccagacttcactgatctgggacaatgacaccagttcacttgcccgctttctcccggtgtagacatacccccgcggagtctctgcaacaaggccattctctcccagtgcattaagatggtcaataatcccttttccaaaccagcggatatcagatactggtctgaccggaagttcagaagcggcgcagaggagctgtccggagaggatataggggtttttcgtgtcgataatggcatgttcatgggggcgggcaaagaactcctccggatgccgcataaaaaactggtcaagcgggttttgcatcgcaataagaatggcaagggcatcagataccgaccggccggcccgtcctgcctgctgccagactgacatcatggtccccggatacccggtcattaccacggcatcaagagacccaatatcaatcccgagttccagcgcatttgttgatacaatcccccgcatcacccctgctttcagatttctttcaagttcctgccgctctttagggaggtacccggcccggtatgcggcaatgctgttcaccttgtcaggagactttttgtgaaggtggtttttcgcccagactgataccagttcagtcatccggcgtgacccggtgaaacagagggactgcaggccggcttcaaccagaagagagaggatctcagcgctttccgaataaaccgacctgggctggaccatctcctgatatggattatacagaataaaaaaccgatctccggtaggtgcaccacttctgtcgatgatcgtcatctcccgtccggtcagattccgggcaaaatcagcagggtttgcaagcgttgccgatgagaggaaaaactgtggtgatgagccataatgatcacagatccgaagcagtcttcttatgagaacagacatactgctcccaaacacccccctatactggtgggcttcatccaggattatgtatctgagccgtgaaaagaaggaggaccactgccggtgccaagggagaatctgatggagttcatagggatttgtgaggataagtcctgcctgtgatctgataagaggccggtcatgctggggggtatctccatcatagatagccggctgaataggcattccggttgccttttccagttcctgcatcgtcttctgctggtcacgggttagggcttttgccggatagatggcaagggcggttgcatcccgaacctcctggcgtatggtgaggaatggcagcagaaaggagagggtttttcctgatgctgtcggagtacagaggataacatcctcaccggctgcaattgcctctattgcttcagcctggtgggagtacagcgttattttttccttctccagccagtcttttacacgggcggggaggacaaccggagccggagaccgggcagcatccttccctgggattctctggatatgtgcaatatattcagagtaccgccggttctccaggagaaattcaagaaaaccggagacgctcataccactctgaaacaagacgctcaagaaggaaggccagacttaccacatcctgcctgttatgttcaacaatcgggaccagggggcctggattcttcgtctccatgtacctgcagtaccattcaggtacaagggcaccagggagatcctcatccctgatgatatccagaatccgtgcctcaagggtacccagcctgcagtccgggacagcatgtttccacaggcgccgtgaggggtggaggagatcataatggggcattgcaggaagtggagggagcccgtaataagccagccggtccgcaatatacgggatatcaaaactcctgccattaaagctgacaagaacggcatcttcagggatctcctccatgaatgcagagagggccggtgcttcctcactgatatcacgaagaagatactgcttcacctgcagctccccgcccctgaagtacccaagacctatcagaatgaccggcctgccaaagataccaagagtctcgatatcaacaaaccggaatgattcaggagagaagagaccggatgtcagaagcgtgagcgggtgggctgccccttttcgtgctgtactgagtcggcagatagcaaccggttcctgctccagtacctcaagcacactgagagcagatggacggtactttctcatccgtgccatatcccgcagcgttttacaacccttcgatctcagccgtgcagatactgcaggaccaaccccccgcaccaacgtcaggtcatgatcaaacagggcatgaatatccgatctgccatgccggatacatggtgcagaagaccgggaactgataacataatactccccctcctgatttctccgctcttcgccggaaaaacagtcctcaagacagacatcagaatagtcacgacagagcctggataacagctgctggttctcgaaaaacacagactccctgaccggataccggttcagaccaagcctgaatatgttatcatgagggacaatggtatactcaggtgatgcagctatcttctcctgccatctcctcccgatacctgcaagatcagcccctgccatactccaaggtcatcgaataagcatataaaggatgaaggccgcagggtgaaagtgaagaggaccgtgtcaccgccttgccagctctaaacagggtctgcctgccattatcccagtgactgcactggtcccgatccggtatacatcatcaagagcagtcgggtgcccggtaatgccaccatatccatccatattagaagcaaggtacccagcacaatgggtaaaacccagaatattaaagagagccctgatcatcggatatgctgtatcaaagacatctgcctgatccatccctgcagtcgagagaaaatacccacggcggagctttttctcctctggactgatgatatgagaaccaaggacaaaatgcctgacccagatataatgggcacgatcaataaatgacttgagttcagcggtaatgcccatggtatagataggtgaactgatgatgatacagtcagcggcaagcatccggtcatagagctcccgcactgcatcgtccatgatacaggtgccagtctgatgacaggcattgcatcctttgcatgatgagtattccagggtggaaagaaccaccttttcggtgatcccccctgcatctgaagctcctgccagaaaccggtcaaggagctgttcagtatttcctcttcgacgcggacttccggagagcccgatgactgtgaccgtcttcttcaagtcaatcgctccttcattgtctctagtactgaccgggagagagataaggcatctcctcttgcagtcgggtgtgacataactgctcctttttcatcaacatgccgtatcatcaggtatgacagatcacggtttttgacttcaatgacgtgaaagaaacatttgacaaccggaatggccgcatcaaacacataatcccagtcttgacctgcggttgagatgaatatgccccatcgcttcccaatccgttcaggagggacgaccgggagtttgagcacatattttctggatctgaaaacctgtgcccgatcaacgagtgctttagcctgggcacagatgctcatgcagtagatgggtgcggacaggatgatacagtctgcctcaagaatctggtcatgaagaagatccataccatcatgattgacacaggcgttgagtttttcacaggcattacacccgcgacagggagcaatatctgcatcactcaggacgaccttcgtaacacgaacatccgggtcctgtcccatctcatcaagaatccagtcaaggagtatctcagaattgccatgtcgccggggacttccagcaatggcgagcactcggataggtgtcataaaaattttttagaggtttttaaagcagagataccagtccttacactcatatccctgggaaagacggacctttgcatcttccatggttgcgggggccgggacgacgaccttctcaccaggctgccagtttgccggggtagcaacgccagccttatctgttgtctgaagtgccttgaccagcctgatgatctcgggaatataccggccattgctgaggggataatagatcatagcccgtaaaatacccttgtcgtcgatgaagaataccgccctgactgcagcagtcgagctctgaccaggatggatcatcccgtattttgaggccacattcatatcaaggtcagcaataatcgggaacggaatctcaactcccatcttttccttgacattcatgacccatgccaggtgggaatggacactgtcgatggaaagaccgatcagctgaacattgagtgctttaaactcagcttcagcctgtgaaaatgcaataaattcagtagtacagaccggtgtaaagtctgccggatgggaaaagagcactacccatttccccttcaggtcggagagttttaattttccatgggttgttaccgcttcaaaatccggtgcaggctcaccaaggatgggaaatcccaccccgtcacattcgcactcttcttcataacacataaacaatcacattatctcttcttcgattacctttccattcacataggcaggcattccggccaggagatacgcgacccggagtgcttcttcaacttcatccttggttactcccagatttttcgcacctgccatctgggccttgattgcatgctgatccctcatggaagcagcaattgcaatcgcgatgagtttttttgtctttcgggacaatgccccgtcatcccagatatactgatccaggcggagaatcatctcatgtatgtcagggtcggtctcagccagtttcttaaagattttggggacctttcctatcttcttctcaagatcatccatccctgaagacatgtccctcacccctgaagaaccatcggttcgccacagcagacgagttctccccctccgacttcaagaactttgactacatttccacagatttcacactcatacacttgtccttcttctgatacatttaccattgaaatctcctccgaaagaatatgttcatcaggcgatacgtggcataaagccgggctaaaaaaagaaaattaccgttttggtggattgattgcatcctcaggggtcttcacatctgaacggatgtgagtcatggggaagcagtcatacatctcacaggcacaggcaggacatttccgtaaatcctgttctgcctcggtaaattcaagtgctttaccacaatcaatacatacgtattttcccgggccgaccttttcgccagccttgaccttttttgcttcggtcacggttgtcaccatatcagtaatcatccttgatctttataactgattcgaatccgtacatgccaaaatagactcgattcaggatataataccggcaattttcactggatcatgaaatgaacctgataggaaagacaatgaattaaagaatgatgatgtgaacagtatagtatgaaaccacaaatccttgcgcttctgggaagtcctcttccggaaggaaatacggcaaaacttttaaaacaggcaatagccggtgctgaaaaggcaggatgcgaggtgaccctcattgatgtaccgtcccttgagttctcatcatgcagggagatgtattactgtaaggaacagtcctcctgcatcatggaagatgatatgatccctatatatccattactcaaaaacatggacagcctcatcatcgccacaccggtcatgaccatgggagttcccggccacctgaaatcattcatggaccggtgccaggttttttattgcgcaaaatatgaacgaaaggcacccctgatcccagcagagaagcgcaaaaccagaaagaccctgctgttatcaatatcaggcatgaacctgcccaataactttgacggaataaagatctccactcaggcattttgtgatatccttgactgtagacttgcagatgagttgctcataaaagatatggataataaggtggatctggaccggttcccggacctgctgaaagaggcatatgataaaggatttgcccttgggtcagccctgaccaaacattcatgatcagaggtatccaagactgcgaagggaggtgaccttccctttggtatagatcaggtgatcaagaaggctgatgccaagaatcttcccggcctctgagagttgcctggtcaccgtgatatcttcagaacttggttcagggtttccggagggatggttgtggatgcagatgatcgcagccgccctgtcggttatcgcatcggcaaagacttcccgtggatggacaaggctgtgatttaatagtcccattgtaatggtacgggtgcaaataacttctgaagcgccattcagggtggtaacgaggaaatgttcctgtgattttccggaaaggtcagtcacctcagatatcttcaggatatgatccggctcggttatccggatccgttccttttctgcaggggtcccgtaccggttggcaagttcgaaacaggccatgagcaccgctgcttttgtcggtccaatgccatttatcctaagaagtgtatcataggacggaaggttgtctttctttagaagatccgcaacctggctggagatggtgaggatatcattatttttcgttccttttcccaggattgctgcgattagttcactatctttcagggcagatgcccctttcttttcaatcttctccctggggcggtcaaggggatcaatatcagttatccgcttggcaggcatatctgtgccctcatttgttatccggagtgaatgatgagattactgatccgatcctctcgaaacacttatccacatggatctcgatcttatcagtatggcaaccaaagataacctaatggaagggtttgcaggggagtcccaggcaaacagaaaatatgcgtcattttcagataaggcagccgaagaagggtttacaaaagttgcaacactctttaaggctgcatcacttgcagaagagatacatgcacgccgccacctgcaggtatatggaatccctggaaccctggagaacctgtccgcagcaattgaaggtgagactgaagaatttacccatatgtaccctgagtttatcaagcagtcccaggcagagggaaatgaggatgccacaaggtcattcacctttgccatgaaggcagaacaggtccatgcaggactttatgaaaaggcacgtgcagcagtaaaggcaggaaaggatctggaagtttccaagatattcctctgccccgtctgtggcaatgttgtgctggaatcagctcctggtgcttgtcctatctgtggtgttccagggaaaaagtttcaggaagtaaccctctgatcctgcagccctgattcgcaaagccagcacaaaatcataacatttttataagcctgcttatgcaaggcatattactaaataggcgtcaataaccacactatactcattatccatggaccggtattcaccagagctcgaacgtgtcaagcacttattacgtcaatctccccgtgggatgacagtcattgaattgtcacgtgcattgaatatcaaccgaaactccatggcgaaatatctcgacgttctggtcatatcaggggacgtggaatttgaccggatagggcctgcgaaacattttttcctctcgcagaggatgccactgtatgagatgcttagtgtgacgtctgactgcattctcatcctggatgcatacaatgttgtcaccttcgcaaatactgcattctttgaagcggaagggttgggaccggagaccatcatcggaaagaagatcttcaccctgaatctgaagatggtcagtgatgatatattaaacgggcttgaaagtgcaggacctggaataaccctgcagaaagagctgatcatcaatgcagactcaaatatcaggatttttaatgtaaagatgatcggaaccgtcctgcatggcggcatacacgggataactcttttttatgaagatattacaaagaaaagactctgtcaggagcgcctgaaatccagtgaaaaactctaccgggccgtagttgaagaccagacagagtttattatccgttatctcccggacaggaccgtcatttttgctaatcaggcatactgccgtgcattcggtgttgacaaggatgatatcatcgggaagaaattcactccgcccataccacccagggatatgaagcgggtacgatcgcagtttgctgatatcaccgtcaataacccgattgttactactgaaaacccggtcattatgcctgacatgacacttgcatggcataaatggacaaatcgtgggctgtttaatgacgaaggggagctggtggaatatcagtccgtcggtcgtgatatcaccagtcaggttcggggggaaaaagcgaaaatggagcttatctttgagataacgctcctctcggacttcacaaccggtcttctggcgatagagaattccgaccagctctatcaataccttggtgattacctgaaaaagaccgcgccgcattcatgcattattattgtgtcattttcaaagacacaaggggccgtcagggtgatctcacagggaactcactggcgaaacaaaaaatggtcagattattttgagaatctcatcggaaagtcatttccctgtatagtaggagtccggacggtcctctcacccggattactctccccgatgcccccgaacatcttcgattatccggggatatctggaacaccattcgcatgccttggcaggtacctgagccagtatgaggttcactgtatgggaatcggactagaagaggagtgccagggatcagtactttttatttcacgtgcaggaaatccaccaggtcccgaacgtcttgttgagacacttctcaggcagaccggggcatttttgctcagagtaaaggaaaatttgaaagagtcataaaacacgggagtgtgtggttttgggagagagtcttcccgtgttctggtatcataatattcagaatatacgtaggttttaaactcatacattcaggtggccatggttcaggaacgaattttttccagggcttcttcagctgcgatgcggacaaaacaattatcatactggcatacctgctcaagatggcgtactgcctctttggcccggatattaccaagggcttcagcaacaatgaaccgcaccatctgatcttcatcctttaagagtggaaggagatgcgggaccacgttttcatcgccaattgttccgagtgcttcagccatgaacatcctgacccattcattatcatggaccagggactgaatcatatactgatatgccggtttccccatgctggcaagtttcaaggcgattgtgcatctttcttcgtttgtactggacaagagtttcatatagtgggtttcaggcatgcttacaccttgtaagaggtatccatacgatcgatagtgaccatccggacataacactcctacactgttccattctcattcagaccggcataaacctacgccatgcgaatacgaaatgcgaatatgcatattctcttcagaaagaaaataccatgagatgatttttatccataggtaatcaaaaaagttcaacttctcccatatccaggattggtacatcacagatcacaacctccatcagaatcagtcatcaggaaatatgtcacatccaggatgcggtatgacagacatgaaaacccgagtataccatatataaatacgtgtactggagtcctgcttcacagatcattacatcttgtgagacatgatactatcatatgtccagcttgccagtgcccgtatgtgcggaagaaagaatatccattcatccgtcatccggccccttattgagtcagaaatcgcctccttccggtgtcctgggagaacaaaatcctgcgatgaaggagagaatttctgatgctgttctcattcttgatgaataccttggtatatcatactacaatcaggaattctcctatctggaatcagctgatgaacgaaattacatcggaaaaaatctcatgcaatgtttcttccggatgattcccccctccatgtacgagtacatcgagacgattgtgccgggaatggtaatcaggaagacctataccatccatgccgctgatcaggactactgctttcagtaccacatactggggactttgcatgggaacggacggccgtgagtaatcatcctgataaaaccagaaccggataatttgtgtacctgaccgatagaaaggcgatagatagaaccaatagagcacactggataggaatgcagaacatagttgagatgaggaggagttcaatacctgcacggacctgacatactggcccgtacgggtattctgatttattcagaaaatccggaataaaaaaaaaggggaaaagagggaaaattattcaggatgactctgcattttgagggtttttatttcaggatcttttcaattgcttcttctgcactgacacggacaaagcaattatcctctctgcacacttcttcaagataaggaatagcatcttttgaaccaagatttccaagggactctgctgccatgaaccgaaccatctggtcctcatctttcagaagtggaagcaggtttgggagtgcctgggcatcacctatgtttccaagtgcttcggccatgaacattcggacccattcattctcatctgcaagtgactggacaatatattgatatgctggttttccgatctttgcaagatcaagcgctacggagcatttttctgctttgtcgcaggatacaagacgtttataatgcgtttcgggcataactatcacctatgggagaaccaggacgaacagcacacaggaaaactgtccgcatgattgttcccgacctccctactcacaactcttgtgagaaccggttattaagcatacgccatgcgtatacgaaatgcaattgtgcatatcaaaaatcagagagtaatcaatactactgaaccaaagggattttattaagcttgaatatcatactgagcgagagctcattgagagatttctcatgattttctgatctcgagtatcatacgcagtctgtcagtcagctctgatcactgcgccatgacgaatcctctctgatcatgatcatccaactgggagatttcaggggaatgtaatgcatggagtcatgccttttctgtataagaaatgcatagaatatatagataaccctaaaggactccaattaaacctttttcaaataattttacaccaaaggaagtatgttcacccgtggcatcatggtgctggtgacacggcgaacaaaggagagaagccatgaaaagactcatcgtttcaggacttcggacctgtgaccgaaaggacatcgtcgaagctgaaatctcgaaatatattatggagataggaggcgtcgatgagatcgtgtccggtggttcagaaggtgtggacctctttgccaaagaatatgcacaggagaatggaattaagtatgttgagttccttccagactggcagagtcatatcaatgcagccagttttatccgggatgcccgaatggttgagtatggcactcatctgcttgtcctctcaaacggaatcagcaaagaatctttaaaccttatcgaagaggccagaagaaaccgcctcactatcaaaacaatcggcgtctttaaaggaatgcccggacatgaaagcgggtatgccggtgcatatccgggaacattctattaatgccatacggtatctcctccgtccctccaaatacatacccggatgcatgagaccctcctctcatgtcttttgtttctgttgactgactgtcccaccctttttttcgcatatcatgattactcctgagagagaatatcggattatgaataatctaaagaagaaaatggaaccaagagatattcgggaagagagaattgcaggattttattttacgttttaatttaatatataaaagtattttttatggagtttagataagatacctatttttaaccacaaatgcaaggatgtttgttcacatgtgcatcggtgctgatgccacatgaaccaggagagaatgatcatgaagaaactcattgtaaccggccttcggacctgcgaaagaaaagacctcgtatatgcagaaatcagcaagtatatctctgaaattggcggagttgacgagattgtatcaggtggatccaaaggtgttgacacctataccagacagtatgcagaagaacacggcattaagttcaaggagttcacccctgacttccagagccatatcaatgctgcaaccttcatccgtgattcagagatggcagaatatggaactcacctgcttgtcctctcaaacggaatcagcaaggaatcaaagaacctcatcgctgaagcacgatcacacaatcttcaggtaaaaagtgtcggaggatttgaaggaccttcagagagtgagatgtacagacctggtaccgtcccgaccctttactaaacaccatccccaaattcctcgggatctctatcaccatacatgggagataccctcctttatcccatgtttcatgaaataaaacgcatggaacgtttttattcttcaaaagctcatcatttctgacatggatgcttttttgcctgaagatatctccccacagacgacggatgaaaaacctcacccgcttctgaaatatctgaagggctttcaggcaggttacgaattttctgaattatcaccagaagagcagtccctctcaacagagatcattgatgatttctcttattatatgtggttgtatcaggatcagacaccgggcaactggacaaaggatggagttgaaaggacattgctcattcactatcccaggtcgctcatccattgcgaggagtatattctggcggtcccgatcattttgtcccgtttttttgcatactgtgcatcagataaccagatgataggagaagaagatcttccggaccatatgccggctctgaccactcagtattattgccggatggatgaatcacagtattggggaccgagaaaagcattcatcttccttgcgctcgccgccggcgttgatagttcccgggatgatgccatgtccacctttatctaccgattcattcaaaaccaggttccaggaaaagatgaacagaccatacgctccttaacgcacgtcttatacgaatggctgttccctttctctgactccagggagctcgcatccctggatccggattcctaccggcattgtgcaccagttatcagcacacttataaaatacctggttattggatgcgggattcctcccatggaatggacaggggcagatatatcgcgatctcttaccgatcttctcatcacaagcccggaccttgaaaacaggcagcactatatcgtccccatcctcctatctttctttaccttcctttcaaaagagcagttacaaccccatgctgatgagatatgtcatgtattggcttctcctgaccggaagatatgaccagcccccccataatcaccttccggttggatactctgttataaacaataattttatccttcagccatgtcagttaagcagataaggataaatgctactttataatttataaaagtatgccataaggactcctgaaaaaatatctatttttaacgtcaaatgcaaggatgtttgttcacaagtgacatcatggtgctgatgacacacgaaccataaggagagaatgaccatgaagaaactcatcgtgacaggacttcggacctgcgaaagaaaagacctcgtatatgcagaaatcaacaagtacatctcggagatcggtggagttgatgagattgtatccggaggatccggtggagttgatatgttcacgaaagaatatgcactggaacatggcattacgttcagggaatttgccccggatttccagagctatatcaatgcagccacctttatccgtgattcagagatggcagaatacgcgacccacctgcttgtcctctcaaacggaatcagcaaggaatcaaagaacctcatcgctgaggcaaaggcaaacaatcttcaggtaaaaagcgtcggtggctttgaaggacgttccgaggcagattactaccacaccggtgcagtcccgaccccatactaaccctataccaatctttctgattcctcacctatcacataccatgagaaataccctctatttctcttacatgtttattatcaagccttttcccgattattcatagtatatcattttttgtgccctggattcaaatcatcatcttcatctgtatacacagcatgatgtttttaaaaggcatgtaggatatgctcgtctatgaaatcaaatcctgacacctcactacacatcctgatcgttgaggataaccggactcaggcagaatatctccgccatctccttgaaaaacggggacatcaggttacggtatcacagaacggttttgaagctttggagagaattgaagagaagagaccggatatcatccttactgatgtgatgatgcctgatatggacgggtataccctgtgtaaaacggtaaaacagcatgaaaagtttcacgacatccctgtcatcctggtgacgcatctgtacagcccggtggatgtgatcaagggtcttgaagccggtgctgataacttcatcattaaaccctatgatcctgagtatatcttctcccggataacgggcatcatgcaggcaaagaatcatccaggcacacaagagcctgtccagccgcttgatgtggtattctccagtgaagtacataccatcgcatcaagccggatgcagatcctgaacattcttctttcaacctatgaaaccgcggtcaagaataacagcgaactgcaggtagcccatgaacggctccattatacgaacgcacagctgcagaaactgattgaagatcttgagcagacaaatgagtcacttcatctgaaaaatcttgaacgaggcaggctcgagaccgcactggctgccgcacatgaaaagatcgagattctctcagaggcgctcaaacagatatatcagattcgggtgcagccggcagacgagattctttcagtacaggcatcattaccggatgtaggagaggggatcagtactgcttcttcgcacctgcatgccggtatgatcgccctgaaaaatatccggcagtatatcagaacaggaacaatgccccggacatggctgggtatcagaaacagtattaataatacgattgaccgggtgcgcaggcagtcaatcaggtatgaaaatctcattcctgaagacattgagatttatgccgatccctgctttgaacacgtcctctcagatctcatcgttgcccttcaggatggagatgagaagccaacggagatgcggttctcgtttcatgtgaaagagaacggatatgtcatcatctgtgaaaacaatgaccagggaatagcagagactgacaaggaaaagatattcacctttcaccatggtctgttgtcacatccatccctctgtcttatcagggagatgctggcactctccggcatggatattgcagagacggggatacaaggccatcggacacgatttgagatcgggtgcccggaatcatcagtccggtttggatcagatattcaggacctctaaaacatggggttttaatccgattcagaaaagaacagccctttcaaaaacaggggatatcgaggaagggttattcataccagaatgaacacatgttcggtgattgtgatatattggcccctgttttcctgtgtgtgattttagcgttcagagcagactccggctcaatagcgtgaagacctcgcctcacacatgagcatacaaaattcgccctatggagattaataggtaaataaacgggtggccgaaagaataaatcttattaacaaaaacataaaaccgtggattccggtagttcaaaaataaatcaggatatcctggagacctttaccaagggaaaaaaatccctgagtatatcagatatctcccgtttatccggccatcacagacacaccgttgcccggtacttagacaacctggtatcatccggaaaacttgagatgcgccagcatgggcagaagaagaagtactatttgtcagatatccaaccggaatcctccatactcaacttttcgcctcacatgctcatcatcctgaacatggatctctccattagatgggcaaatgattcatttttacggatgatacattcaacaattgaagccatctccaacctgagcattgaagcactacatcttgatgacctgtttggccctgaccttgttgcagcaatccggatggtccgacctggtgaaacacgatcagaagaggcacgaattatccgtgaagagaaagagacgctgtacctgtttaccatatccgccgtctcgttcttccaggaacgtcctgcgcttgtgatcaccggggaggacattactgaaaagaaggcccttcaggaggcaatacgtacaagtgagtcaaatcttcgtcttatcaccgaatcagttcatgacatgatcatcaggtgggagcctgacggaatgatatcctatgtctcacctgcatgtgaactgctcaccgggtatgtctcccaggaactgatgggaaagacgatatcagaatttattcatcccgaagatctcccccggtttcagaatggtggtgaaaccgagacggtgaactggtcccgcctcccttcatcattcagattccggacgctgaaagggaaatggatatggtttgagaccaccacaaccccccggctttcagagaccggcgagattctggactatatttcggtctggcgggatattaccgcatggcttgaggcagagaccaagctggcactgagtgaagaaaaataccgccgtctttttgagggtgcaaaagatgccattatccttatggaactgaccgagaacttaaagcatgcacgatttcgtgaagtaaataacctgacctgccagctgaccgggtatacctatcaggagtttctgaccctttccctgtctgatatcattcctgaatccatggaggagtattttaatgaggttactgaaaagttcatgcagaatgaacaggggttctttgagatagatctcgttcgcaaggatgggagtctggtcccggttgaagtaaatgcccacctcttttacctgcagggaaaaccggttgttctcgcaattacccgtgatatcactgaacggagaaagactgaagcagcgattaaagaagcacaccagcgtcttgaagacatacttgaattcctccccgacccggtcttcgtgcttgatactgaaggaacagtgacggcatggaaccgggctatggaagaactaaccgggacaaaaaaggaggatattatcggatgtggagattatgcctgtgcagtcgccttttatcatcagaaacggccggtcctcgcagattatatcctccatcgcgatgaaaccgtcctctttcggtataacaatccggatatcgacggagaccgggtcacggttgatgttcagaccctgcatccggttacaaaacagcgaatctggctgtggataaaggcagctccaatatataatctcaacggggacatcatcggagtcattgagaccctgagggatatcagtgaacgaaagataatggagttggagattcgaaaacagaacgcgattttcgaagcggtaagccgggctgcttcagatattctccagtcagcaaactttgaagatgctgctcttcggaccatcggcttgattggagaggcaacatccgtcagtcgtgtctgccttcttgaaaaggcaccctcatccagtatccagcttatcagatcagaacttgaatggaatgcgaaaacaggaattgtcggacggacccggtctcccttatcaatgagactgaaaaatgacgatgaaggatcgatcatagaggatgtgttcgtacaagagaagaccatctacagtctggtaaaagatctcaagggaagtgatcgtcggattcttgaaccggaaggagtaaaatcaatccttctcgtccctatcaaaaccaaaactgatatctggggtgctgtcgggtttcttgaaacaaactctgagcgtatctggagtcgaaaagagattagtgctctagaaatcggatcatcgctcatcggaagtgctctcatgagatttgaagccggggaaaatcttgaaaagagtgagaaacagttcagaaccctggctcagaacattcctgggatcgtgttcagggtctcacttgccggttcagacatggagttttacaacgaccatctcgaatcggtgaccggatacaccgcaaaagaacttgcaagcggacagatcagctctcttatcccacttatttttcctgatgacaaacagcgggttattcaggcaaagaaagagtcaatcaaaacaggagagccatacgagatagagtaccggattattgacaagtttggacatataagggtcatgagcgagcgtggcagaccagtcgctgatgaaaccggacttgtcgtcagtattgacggcattattcaggaagttggatcaggatagcctgaaggacgaatcaggtgcaaccggggagtacccggaaaacaaccgtcgcttattcacaaaatgcctgttcaaaggccatctggttatgagagtaccgaaaatgtcttcgaatggcaacacttttactgattggatttatccatgacgggtggcgatttgccagaggcgatgcgtgataaatgaaaaattcgccattccctgttttatacataaatgaaccccgttcttctcgttctccaatcagaatggaggttctcgtgtcatatatatgaccatttattatctctttcacgtgcacctgcgcaacgatgcgcctgaaataaacggcctttgagaatataatactgatggaggagagatggaatacctaaatcaggaaatattcgcattttgcagcgccgggacatatttctggtctatcgtggagagatgctcattaagccagttggtgaggaaaatggtcacttctgcactgagcgcttcatcattctgattgtatttaaataaaaaatcattcaccttcgagataaatgcatcatgaaagatccggtgttcggccagatcagaataacctgccctctccatgagagattcctcggtctggaaatggtactctgcgtaccggttcatctcctcaatcacatacgatacttcctctttaccccgtttttgcaataatgcctcaaacatccggttcagaagtgagataagatgtttatgctggtcgtcgattgattgaataccggtcgaatatacctcatcccatacaataaatgccatgcacgattctctatctcaaatgatatgaaacctgtgatatcatgcgttggaaaaaaataaaatgtaatttattttcggatataaaacctgaccgttccctcctcttttcccggtccgtccggaataaacccgttcttttgaaggacccggactgatggatagaggtgcgggtaagtagtcgcatacaccgtcccgaaatctccctgtgaaaacacaaagtcaaggatggtgccgaccgcttcggttgcatacccccggcactggaatgcctcaagcactgaatagccgatctcacaggtcccatcctcgtttatatagagcccgccacttccaatcagaaccgggcgactgcttctcccatccgatttcaaaatccagtaccaggcacataaccggcaggatgacggatcagtgagcattccgataaattcatgaagggtttctttggtgacaagtggcggaggccagtctcctggaacatctgcatccagcaggagggataatccgtagttttctttcagttctgcagtacaactggcgaccgttaccggaaccagactcagtcgatgactcgaaagttcgtgtgctatcatggataattgattctgttattcgcatacgctactgaaatctaaaagccaggagaaccagtataacgggagttttacaagaaaaacacaccatcatgcacggaagatgcttcccggaaaagtcctgacagaagggagatcaaccggacaatcatggcatcaccagagaaatattggatataatacaatataccgcttttttcccctgtcaaagaaaacaaaagacaaatatgaagaaccgaaaacggtatatgatgagcgggctgtcgccgttataccgaatactgtttgctatcctcctcatttttatatgtgttgcagggtgccttgatgaaaaatctgaacaggggagagtgattgagaacgagcagaacagaggtgttgttccggtattctcaccagccagggtatcgcaacaacagactattgaagatgcccggaatgtctgtgatgcggtcacacaaaccctgacagccgaacttgagaccatcaatatcgcccttaggaaaggcgcggactatctggtaatgcagggggtgaacagccctcatgcagagaaggttttgtcagagaccaggaacgcttcaccatatacatatagtcccattctcctgaatcatgaacttatcataaccggcgttgcatcagacgagtatgccgggatcatcggatctgatctctcaaaccagggacatctgcaggacgcaatcaccctgaaaaagccggtcatgggaggactcatccagacggttgagggaattttggcaactcccatcagctacccagtcattgtgaacggtacggtaaccggagttctttcagtccttatcgaggagaaagagatcttttcagatgccatccttatggctgatccggagaggagatatgagacattcatcatgcaaccggacggtctcgtcatctatgataccgatccactccagatcaataaaaacgtctttacagattcattcttccagaagcatccatccctcactgcaattgttcatcggataaagaatgagaccagtggaaccggcgcatatgaattccagaacgatatgtcacctgatctggtgacaaaagtagtagtctggaacaccaccggcctgtatgaaggagcctggcggatagttgtcagccgggtaatctgtgagacctgacccccaggtttattccagggaaccggtcaggagggttgcatctgcttcacactcatctcttgctacacgaaggcgttcctgggcatccatatcatcgggttttatccgcatgacctcttcaaatgctctgacagactcacaatatcgtttagttgcaaagagcagaacaccacgattataccatgcctgggtgagattccgatctgaatccaaggctttgttgtagaccttgaacgcctcgtcatattcaccacgctgcatatggacattgccgaggttattccatgccagggcaaatgactgattcaatgcaagagccttgtgaaaatattcgatggctttttcatactggttcagttcataatatgcagtcgcagcatagtaccaggcgatggaattttgggtatccagtgctgttgcttcgaggcacatctcaatggctttgtcatactcccccagcagaaataacgtccggccgatatttccgaggatgacagaatcaccccctccactatcccgtgccgcctcgtaccgggcaagtgcccccgtatgattaccctgatcagacaggacatttcccaggttgttgagaagagcggaattattcggatcacagaccaggccctgctcataggcttcttttgcttcagataatctgccctcctgatggagcagcataccggcaagaaaccagtactcataagaatcgtccattccgatatcagcaacacctacctgattgaagagaataacaatcaggatactttggaaaagtctctgcgtatcagggaggataaacaataaacccttccttttctccccggagaaaaccagcctgctcataaaacctgaatactgcctcactctttctaccggataacagcataaccttgtaacagttcttcttccatgcacagtcaagcacatgacagatcaatgcagtaccataacccttattccgaaactgctttccggtcactacattctcaattataccaaatggtcgtgcccccctggagaggttcgggacataaataaacatgcatgtagacaccggaacaaaatccacctccaggataaaaggcatcaacgcaggattatccatgatctccttccaggcataggacaattcctcctcacctgcctgctcatcataatcatgcatgtcagcatagagggagagaagaatggggagatccgaaggatcagctgttcgtatatgcagatgagccatagaatatatgaaaaacaggtctctcttcgataataaattgaaaggtatcactcaaaagattcgaaaataagaactgaacgccattcggcatatcgccctccatgatcctttccggaatcaaacgagaagataatggggttacattggtgcaggaaccccggaattttcaatctgacttttcagatccgcaattctcatctcataccggtcaattgcccgctccagaatctctttctttatcctttggatatccggctcctgattcattattattcccctgcctgctatgtcagcaatgtattcaatgcactatccgggtatatcagagtttgccatgcaatagtgccaaacaatacgattttgattcaaatggaaaaataatgccgggattatgattattgcgtaatcttccccatgaccagaccgaaaaccatatctctgcacagggcacaacccggttatgaacagacgatatcagatcgtattctgtttcttgttaattcttatccatctcgccctgtggcaggtcctggctgaagaagagagcatgcctgaaccattcctcgatcccgacgatatgcccggacccattgatgatatgttcttccctgatcccttcccaccagtcatcggaggtgatgttggatggttccggattacctcagaaccttcaaatgcagaggtcatctttgatggctctctggtagggtatacaccggtgacggttgaagtatacaccacaggtgctccataccataccgtcaggatcgaaaaaagcggatacaaaccatggagccgtgaactgcatgaaaacccggcagcaggagagacaaagccggtacatgcaaccctgggccctgatccctgctgtaaaagtcttcggataacgtcagcaccatccggggcacagataaccctgaacggagtataccagggaaccaccccaaaaaccattgataatctgataattggctcatatcaggtcaccctgaccagatccgggtatgagacctggaatgggaatattgaggtacggccggactcggacaatactatatacgtggttcttgagccgagctttgccccaatcacatcaggtacactcatgatcgaatcatatccggagggggcagagattgttcttgaccggaccagccggggaaccaccccccgaaccctgaccctccctgaaggttcccatacccttgtcctgaaccttgccggatatcagcagtatacgacatccgtatttattcgggacaaagagaatgcacgtattaccgcgtacctggtgcctgtaggatccatcccagcacaaactccgaacccggtcatcgttgcatcaccggtcagtgacactccatcatatcctccatcatatgtaagtctcaccgttcttggagagaaggcggcatctcaggctcatcagaacaaaaactcattcctcgcggcagtcaatgatcctcagggggcgtttgcgggcgatacagaatttgtgagtgtccttgcagtgaatgggacccttctagccgacccggctgcagcgacctggattggagaggagattgccacctacatggatcagaacacagttccctatggacaggcaagacatgcacttgccaggcacgggggtggaatgctctatgaaaataactataacaatgcctcttctgctggtgaactgctcatatcagaagtcagggctgaagaagatgggctcatcattaccgcatcccgccgcatgcagacagcaattcctatgatatcagaagcgaccatcagatccctctcctctgtgtcagaaactgatgcagataagaccggtgtcccgtaccagcaggtggttgtccctgcagaacccaaagacccgacaggtcccggagatactatccttgggcctgacagaaacggaatcagtctgtttccggcgatttatgctctcgcatcagaaggaggaggactcttatatggtattgaaccggacggaactgatattaccctcttttatgtgttccctgaaacagacggacagatactggtcaggtgggtgtctgaaccagggagggagcacaaggaagaggaccttattcattcataagtcaaaaactctttttattcaggaaaatatgagcatccggctggatttttcctgcccggaaagttcatcccttcctgcacctaagcctgccatatgtattctcgtctggtgtggctcatgctcattctgatacttctcagtgtaccggttctggcaggtccggttattgttcctccagggggagaggtctatttgggagaagagggacttgacatccactatgctgttccgtacccctatacatccatcgcatattttccggcaggatcttcccctggtcgtgaccagccgcttgacatcatgcaggtgaatctggggagattcagtgtaattcctgacctcttttatgaccggaccggtgcatggtaccagtgggaccaggtacggggaactcccggccaggttgcgtttatcgtcaggaacccgcgaatatcgttaaaggttatggaccggaacacgatgggagatcggtcatatggcacggtatcgcggggaacgcccctggtcatccaggttgaaacaaatcttgccggtattacccggagaccggattactcctacaatgacgggccggtgaagatccagataaaaactcccggaggagggacgcttgccggagtaaagacacccggtggtggccagtatgtcttcagttcattcatgccaaccggggaactcgggtatgcccctccgattgagagcggtggatgggacaccggctggagcgggtatgaatcaggcctctatcatatagaaccaaaatttgcggtgaaccggatggaagacaatctcaggtcctatgagggcggatataccctccggggcaccgacattacgctcggaaccgaacgggcgggacttcatctctcagaagagaccgtggtgagaggagatccatttggtgtaacgattaccggatctccgggatccccctatatcctttggattgagggaggaagcagaactggttctccaggtgaccagccaccgatgatcatcacctcacaggaaggggtgagacaggataatcctgatggaccctatatcatcggatcctatcgcccctccggaaaacacactacgattcgtgacctcgttccttcatacccgtttggcggggtatattactatgcagaagtgacgcctgaccggaccggccgacggacgattgagtggaggacaacacaggagactggtgaccggcgatacaccatccatatcgaaggccctgcaggatcagtacatccacgatcagacaccatagacgtgcagatagtcaaagggtccgtatccctcactaccgggagcgagacctttaccattggtgacgaggtaatgctcaggggaacaaatacaggctcgtgtgagacgtacctcttcatcaccggtccaaaccttccgtcagcgggtggcagactggatgccccacgacggcaggtctctgatggaaatccgggaagtttcacgacggcatccggtgactgcgatacatgggagtacaggctttataccggcgaactgggcctggataccgggacgtataccatatatgccgtgtctgcaccacgtgaccggtatcacctggaaagcacctcatggcaggcgattcccataacactgaaacgtccgtatatctcggtctcaagcaggagaatgacagttgcacagggtgatgaactatcgataaccggatcgagtggcgggcggactgatgctggggtagccatctggatatttggcaggaattatttcaggtatgacacggtgcagatcgagcggggaggatggttctcgtatgaactttccagttctgtcacccgtgatatggcaccaggtgaatattctgtcatcatccagcacccgatggccaacgggaactttgatctctggccagaccggaatcgtgagatggtgctcggagcaactccctggtatggcgctccggtgttcagaattgcaggcccgggggctcttcagggtcctgctgccgctgctgccctgattaccgccctgcaaagccagtttattgatgatacctataccgagtactcaatctttgtgcagaacccgaagattaccatcacagcaggatcactgaacggaacgacaaagatgccgattgtcctgtcagggacaacgaaccttgcatcaggttcacgcctccttgtggagataaccgatgagcggttcgggcctacccagaagggcggtgaggggagctggtccggctattcaggaacgacaacaacgtatccgggatcagaagaagagcgggagttctcatttgagatcccggcaggaacactgaaagaaggacgataccaggttcttatccaggcggtctcctctcctggtactgcatcaggtgttctgcaggtcacaatgccggtaacgcctgtacagaccatgacgatgaacctgacaccaccccaatccccggaaccaatccagacacagatacagatccagacattggaaccagagccgacaaccgcggagcctgtccaaacggagaagccggcatcgacaccagatcaggtccacgagactccgactgcggatacgaatggaatgataccgaacattatgcggacaatgcgggaaccacctgtcctgctcggttttgggattctcttcggcctgtgcgtagcaggacttattgcagcactggttacatggatgcgcaaagagagagatgaagaagagaatgattcagagggcagtgatgaaaagaatgtgaaactcgctgaaagtaaagaggaaatggacgaggattccgattcatacgggagatgagagagggagtgaatacgaacgtgtgcggcatgacatggatattatttcctctttctcttttcaggcagatgtttcaaaaccactttttaccggaatgccagaatgtgtatcaaaaattgcgcgccgacaggaggaaagataccgggtattttccgacaaacaaagaggggattacaccaccatataaaattttacccggtgccctggcataaagcggcattgtaccttataatgttcaaaaatataccggtaaacaggtggggaggcacatgactgaagaagatcctctatcaatagtgcaggtgcggtatgcacggggagaaattgatactgcagagtatgaagaatttctctcctggtttttgaaaaatatctcattccaacaggttccttctctgaagatagcttcagagcggtacgcaaacggagagattactattgggcagtataaagagatcatctctcatcttctcaatgatatcggcaattatcagcagagtgctccgctcagggcaattcatctcaggtatgcagaaggggatatcgacactgctgaatttgaggagaaggttggggttctcatgcgggacattcctgcatatccctacaatccgccacttgcggtcctgtttatgcggtatgcaaaaggtgagatcgataacctgcggtaccaggagatgctcacccatctgtcgacatactgcacgccaaatctccccagtacgccaaaggaggcatccactcctcctgaaccacagaaaacttctgctccctccccaaagcccgcagcaccccctgttggacaaaaacctcctgcctcatcccctccacctgaagcaccccagacaccggatccctaccgtttaaatttcgcagcagttcagaaccctccctctccctctccggttggtgatgtcagtgcagtccacccggacatacatggcggattacccccggagatggacatcggaggactgggaggatcaggttccggagtcatcagtgagcagcaggtgatgatggagccggcccgggacatcacggctgaacggggatcataccatattaccgatatcagtacatctgccaccccggtcacggttctggtaaaaccggacatggaaatcccgaagaaagagacgaccatctcatttaagcagaacgtatcagaagttaagcctgaagaggagattggcgcaaaatctgatcaggagtcggcaccatctgcaccagccccggaacctgacaacatcatatcagaggttgccacttcaccctcagggaaccatcagaagattaaggcactcattaagcagggtaaatactatgaagccattacccgccttgatgagatgcttcttgagtcttctgatgactaccggtcattgttcctgaagagtattgcactttttaatatcgggaaaggtgatgaggcacttgaaatattaagcaaagcgaaggagtcctgcaccaacaaggatgatgcgaaagagatagagcggatctacagccatattgtgcagaagggcggaagcaagaacggacagaagaaagagaaggagaaagagaaggagaaagagtctgcacagagtgcacaaaaggacgtgggcaaagtcccttccctgacaagtcatcctgaacgggtaaagaacgaacactcagatttgatcgagaagatctgtaatcaggcccagagcctgattgacaccggcgattataaaggagcaaatgagatcttagccgatatccagggccttgttaaggatattccggttgaaatcatgcagaaagagtctatcgacgacctttttgcagcaaaaggatttgtcctgtatcagctgaaagagttttgtgaggcgaaaaaattcttcaaggaagcgaccaggataaatccaaagaatgagaccgcgatacattacctgaatgacatcagggttcgtgactgtaacaagtttgtccggcacgtataagtcatggtaaacccatgaccatttttacacctgaagggcggttcactatcaaacactatcttttatataatatattggataattggatcatacagatatctggcctgtttgtgggatgtgagcccccggtatccggaacggaggtatatgatgaatgatgaagaggacatgctcgagcttctcgacgatgaggggacggctgatcagcttgacctggagcttgatgagccggaagaggaagcttcgccttacgttgacgagagtatagaagaagcagcgcctgaacctgaggaatccgaagaaccggaggagaccggcgggcgcgaactagagatcgatatcaggttaattattgttgcaattgtcgcaatagcagcgatcattcttgcaggagtattttttgttatgcccatactgatgccggctggtccgccgacggttaccatgacgccaagtcagtctggagaagacgtattcctgtattatgaatccggccctgagcttcaggaacaggatgtaagatttacgctgggcggcgctgaaataccacgggaaaagatcatgctgatggggggcgtgacatggccgtggacacaggggacggtcctcaaggttgacacctccggatatgaaaaaccggcatctgtggcggtaatatatacgaaaggggaaggtgaaactctgctgttttcagcaccagcagagcccacgccgacaccaacaccgactcccacccctgagcctacacctgaaccggttatgaccccggagatcctggttccgtcccagccgattcctgttcagccggttcagatggaggatttcatgaaccagaccctgatcaggtttgatgcccaaccgaccaccggcattcagccactgaccgttcagttcgctgatcagacacaggtgtgtgcacagaaccggtcatggaactttggtgatgggatgacatccaatgcacgataccctgagcacatctatcccttcccgggtacctacaccgcaagccttgacatgaccttctgtgaccctgatgagtcatcagaaacaccggtaaaagagatcaccgtgctcccggttgacaggcaggacacgcttctttcaggccccggagcagcaagtattgatgcaggaggatcattattcttcaccgtcaggggccctgcgatgttgattcgaataggaggaaaggattactatctgaagaagggggacctggtcagaattgacctgaacgatgggggcaccggatatatctctatcataaacaatgcaattgtccagttcaactttgaaaacgtatcaatctgggtaaatgacaaggaatttggatccggatggcttacaaacatcaatatcaatcaatatgagcagattgcatcggctgacatcaccatccggatcatcgcccaggaacctggtctgaaaggactggtaaacgggattccggcgattgtggcaagtccgggtcagatggtaaccctgcacaatgtcggaaccgattcaaccggcaagttcctctttagtatccaggatggggcaggattttccttcaggggaggcattgaatcatatgaagtcactactcccttttgaatatttttaaaccagctaataatcaatgaataaaggcaatctgtgcgggggtgcagaaaggtgaggaaatcgggatgggtttggtacatgaataaagaacacgcaatgacgcagattcagacaatcgtggtcatgaccgttatcatggttgtgctgtttcttcttggtgtgatcctggtggtatggaatccgatacctgaacggataccccaggccactatcagtattgaaggcgaaggcgactcgatcgtgatgcaacacattgatggtgattcgttctcatcagaccggcttatcatcaaggtgaacggggatgttcagccgaacacaaatatgaacttccagggcggtacatggccctggtcaccaggagaacggatgcagttttattacccggcaccggatgcaccacgactggtagaggtgctgtacgtgaccgacaagggagacagtgttctgatagacaaggctcgacttgatcccccaccggtggtatcggcaactccccttccggttgagatggtccttccggtcaccccgactccgcttccgaccaacatcccggtaaatttaaaggatgcaaacccgttccagccacccatcagtgattttaccgctgaacccagggttggcgatccaccactgacggtgacgttccatgatctcagttacgggcaggtttccgaatacctctggagctttggagacggctcgacgtccacccttcaaaacccggttcatacatattttgtaccaggagcatacactgtcagcctcctcgtgaccaatgcgtatggatcaaaccgccggactgccggggactttatcgtgattggatccccgccggtcgcaaaataccttgccgaaccatcaagtggacaggcccccctgaccgttcagtttactgatctctcaaccggcagcccgaagagctgggaatggtcatttggcgatgggacccagtcatctgagaagaacccggttcacatcttccagtatgccggagtatacaatgtcaccctccgggtcaccaacgcttatggaacagacaagtactcccaggaggctggtattaatgtcactgccccgaccaagatggatgtatatcttgcaggaagtataaacggagcactcatccctgatggatatgttaggctcagagtgactgatccggcaagttccatgaagatagccgggaagatttttacctttgaaccaggagatatgatccagctcatctacgggccgggatccatggatggaaccatatccaccgataagaacaggtttaccgcattcaactttaatgatatcacccttgtcaagaatggggagacgctggcacgtggcccggtcaacagtttctctcttggcgggtttgacagctatgcatcaaccctgaacctcaccataccaagaggggatccctattcaacgctgtatatcaattctgaaccgtacaagtatgttgaaagtccgaagttcacgttctccggaatcggaccggatagtgctggccggttcttttatcagaaatcagcccaggctatgaacttccagggcgggattgccgaacttaccatgggataacccgggtacgatcggcaacctttcattcttgggatacgataccataggcacacacgtatgccagacccccgattaatattttcaatcctcattctttcattgatattctccctccatggaggcgttattgccgatataaccctgtatacaacagacttttcagacgcaaccgggtgggaaacgaacagcccgtcgtcattttatctggatgaagggaagggacagtaccattaccagataacaggaggtaccggatcctatgcctattatcccctctcagggccattcaccggtccgttcaccctggaatttgatgtgcacccggtgctgaccgaagagaagagttcattcaggtttggtcttggaacggaaggatatgacagtcagaaaggaccggttgtcctggccgagctttataatcagaatggagaaggggcttttgctctcactgcaatatctaaggaaaacctccgttcccagacgtactccattccagggaaagcaaattatagtggaaaaaccgtgcgatttgtggacggggaggagtatcatatcaggcttacctggtacccggttgaaaagcgggtcagtatgacggtcactgctccaggtgatgataccccgttgtttagtcattttgtaatggtaaccggtaagatggaagagtttacccacctgtttttgacttccatcggtgagggacagaacggaagaaaggcccacgggtatatcgacaacatcagtctgacatctccaagttcagtccttgcaacccctgaacctgtcatcacgtcacaggaaccaacacctacaccaactctggtgaccagtgtaacaagcgtcgttcccggacagaatggtgaaccggttgatataacacctgatccgatccccaaaagaacccctcttcctgcaccaccgacccctgtccccactgaaaagtcaggattattacccctcatcgggattttgggagttggattcgttctcctccttttcaggagataaattatggatgaacatatcatagaagcagccggacgttgcagagtcgtcgtcagagatggtaaagtggtcgaagtaggaagtcctcttataaccgaatgccctcttgcacgcagatttgcctgtccggtcaatgagatgacatctgaagcaatacgggataatattcagaaccgtatagactcgtttgggatgtgcaccccaggtcgtgagcttacttcagatgaggtgtttgtcggatttggagcgtcagaaataatcagcactgccctgaaaagccggtttattgatgcagcggtcatcgtctgtgacggggccggtaccgttgttgtcacgaaaccggagatggcacagggtataggagggagaatgtcaggacttatcagtacgtcaccgattcctgatgttatccggagaatagaagatgaaggagggatcgttgttgatcctgaccatgccttccttgatcccattgcaggcgtccgtgctgcgaaaatggccggatatgagcatcttatcgtgaccatccataatccggaggatgcacgggcgatcagggagtatgattcagatgctatcatcatcgccgtgcatactaccggttactctcacgaggatgcagagaaggttaaacaatatgctgatatcgtaaccgcatgtgcctcacagactatccgtgagatctgcggaccatgcgccattcttcaggcaggatccacagtgccggtatacgccctcacctctggcggaaaacacctgatccttctgcgaatggccgcgatagaatacccgctctttgtaacccatgcagatctgcctgtctccggggagaagagtccacaccccctgatctgagagtcatctatttatctccacacgcaaaaatccaaaagctgatgagatctatacggaccggaatgctcattgcactgtgcatttccctcttttcatctctttccatggccgtaccgatgcctgatgacatgatttttttaaccgaagaatatccaccatttaattatcttgaaaacggagtgccttccggcctgtctgtggaacttctcaggacagcacttgagagagccgggatttccttctccaccgaagatatcagtcttatggcctggtctgatgcataccggatgacagaatccaggaacaataccgggcttttctcaatggcacgaacaccggagcgtgaggcacgcttcaaatgggctgggcccctcatgcaatgccctcttgttttctttgctgaaaatgaatctctgaagacggcacggccggagaacaaggatcttcgggcagttgtcatcaaagatgatatcggcctgtatgtcggcagagaggcaggaattccggatgagaacatattccaggtgacaacccctgctgaagcagttcagcggctgatcgatggaacatcagatgtatgggtttatgccctgtatcctggtgagagcctgattcagaccatcgcagaaaatccggaatcattctatatccttgatgatctgggcaggtcaacctactacattgcatttaacctgaatactgatccagacatcatcgatgccatccagaccgaactggatgcgatgaaaacggaccgcaaggatgagggaattaccacctatgaaaagattgtcgggaaatacgtaggtccgatttgtgctgaaaagtcacaaacacggcaacagataaccaaccttgtcaatctcactgcggatgccatcagccgggatgcaaccggaacccttgcagatattcagaacgggcgacatccgtacaaggatcggtctgacccttcattatatgtgtatgtctttgataccggagtcactcttattgccaatgctgcacagccttcccttgccgggacgaacttttcaggaaaagtagatgcgtcggggaagaaattcagggatgagatcgtgaccggagctatgaagcagggttcaggtattgtgacatacacctactcaaacccgcttgagacggggattttctacaaagaggcctattataccctcgtgacagggagtgataaaaagcagtacatcgtctgtgccggacggtatctctcctgtgacgagatctgacctatttccatctttttttcacatgaaacagccgcgactgctcttcccgctccagttcttcccggcttgccgtaatcgttgcgatagacgcttcgagtgatggtattaccacatgctcgagtgcctttacccggcgggaaatccgctctatctcggttatcaggtgattgagtgccgcggcatttccggcatatgcaataattgcatcaacgagcttctcatacgcatctgccatatcatcaatgaccaacgaagtaccgaggagtccatatccccgatccacgagatctgtcctcacattactcccggtaatcaccgggacccggataccaaagaggttcttttcagagacttcaatctcggtctttgattcaaccgagtatgccgcaattgtgacattaagcatcccctcaatcatgtaggcaggggccagaagatgcctgacccgccggtacctgaccatgagaagatcatattctgccttcacgagaggagccagctttgtgacttccagaataaggccatcacgtttcatctgcaacgtcttataagacctgacggcgattttaagtcttgactttaaaacaaggagttctgattttgtcggcctgatatcacgaagatatgacaccttacatcaccagatgctgtctaataaaatccggattaaccccgaactgcttccctctcgctatagcccgaaggtttgcaatctcataccgcttgtgctcaagataggatatgatgggaagaacagagaactggtgtcgccgtgcaagtccgtccagatgatgaaggagcatggcattcaccgagagcatgacggtgtataagggtgtcttgtgagccgcccatcttcgccagacgacatctgctgcatcagcctcacagacattctcatcacatcgcaggtttttgagtgcttcggtgagtattgacaggatcccggcacgggacagttcattcacaaaggtctcccggtctgtcaccccatagagcctttgaaagtcttccggagtcatatatccgcctgtcaccataaacggggtgatatcagacacgttgctcccggcacgaagcctgaatatatttctgatattgaggatatctatctcaaaccgcaggtggggaaggatgacatcacctcccctgataccaaacctggcatcggagagcagatttccataatacgcaaggtaaagttcgttctccagggaggcgaagaggccacgacggtatccgtcagtaatccgggctgagagaatattataatgaatccatgaagagagactatcggtgatctcatgaatggaccgcagggtcaggagatggtcaagatgggagggggacaggacaccggcaggaatgagcacggcccgtatccggtcaccagggatgtgaaactggcatccccgcagaataagcatgacattctcgatatcccatcgcgaaaagtattgctcagcaagttcttgtaaggctccgggggcaatagagaggatactccggtatgtttttgcgagattttcagtaagagcatgttcaattaactcaatgtctgaataggcagaggagagcgtatgcacctcttcatggtatccggattctccgataaaccggatgatctgggaaagctccatattcaggagccggttgtactggtcaggcgaaatgagagacttcttcttcagcccaatccgggtacagatataccggtacgaggaaggggttaccagataatggtgcatgataggagtgattttctattctgctacaatatataagtcaggtatttcatataccctgtcatatcgtatgtcatgagagcggaggtgacgaaccatgcattccctggctatagctgccatcaccaacaccgggctgtaccgaagacgcaatgaagacagtctgctggtgggcagagatgttcttgcctgcgtatccctgactgaaccaaaaacatggaggattgattcatatccggtcatccttgcagttgcagatggtatcggcggcagtgtggccggagatattgcaagcagggaggtgatgagatgtctggcacgaccactttgccctgaccgggaggagacccttcataacctgatacacgcagcacaaacccatcttgatcacctggttgaaacccggccagaccttgacgggctcggaacaaccctcgcaggtgtgctcgctcttcatgaccgcataatcatcttttcatgtggtgactccagggtgtatatgaacttacctggaaatgagggaatacaatgcatgacaaaagaccattcagttgtccaggagatgatcgagaccggacggctgactgaaaaagaggcacgatcccatccacttggtcatatcatcacctcatgcctgtccgggggacgaagaagaagctcacttgatatcagaatgtcaactcaccccatacagaaggggacacgactggttctctgcaccgacggggtttgggattacggaggggaactctttctcaaggcagcattgagaggggatccaacctccgcaacacaggagattctttccatctgctatgatgcaggagctccggataatataaccctcatcatcgctgatgttgagtaaaaaggttaaaagtcgtcccagcttttgttcttgtcttcgatgaccaccaaagacagggtcgagagttcatttattccgtcaccggtttctttcctggtattccatggatctatctttatcgtcaggtgatttggaagccgtgggatatcatggggaatcatgaaccgcaggtcaaacatggcggatgttcctcctttcaggggcggaaaggtatcagtgaccggaatgagcctggtatcaccaatccatgcctctaccgggacattgccaggggcgatgtcatcgcctccctgatttgtgatgatgatccggggagtaaccgaccttcccgggcgggtatacgcataatcacctgccagagagaccttttccagaacatagtcatgtccagctgactgaggcgataccacctgggcaggggcggtgaagacgataggcgatgtaagtgacttgtttgtatcggcgacgacaggaccggtgagcatcagaagaaatccgatgctgatgaccagaagggtaaacctgatattcatattatgcctcgataatcctgtataagttagattatctattaggaaatggtttcctctatgggttttaaagcagcccgaaccatgcaatatacgaggtgatgaccatgatgaccaggatgattatcaaaaccttatagatgcaggaatgacagataccacttcccatatggatacatgcagagcagtgattttctttgcaaatacgacaggtatattctccgtcatgatcttcatgatgtatacagggagtgactgacataccatatactggcaggttcttttgtaaaaatccttggtgtactccctgatcattacgataccccaccgggatctaaatttttctacaggaacccatatctctcatatgtatttggagttatattcctcctgtattcagaataaggaatatggtttcatctcaaactatctacacggattctgaaaatctggcttgaaggatacactgcattcagagtcctggatttgaaaagcaatcttttcaccttgattaccgaaaccttttccaggcacgataacgtcacccacagagagatcccatcatctggaatggttcgacctccggcgatatatgaacaatcctgatagcaggtttcttctcatttcaatgaaagatagattgagcaaccaaatgtcagcatgtcacatgtgagataaagatgcagtcactgaaaagaagagtctttgatagtatcgatgataaggatgagggagggaaaccgaacaacatctttgactttttcatcattttcatcattattgtcaacaccttcgtcatcttcattgagacatatccgaccatccggaataattacacagaatatctggatcttattgaatacatcaccattattgtctttaccacagaatacctgctcagaatctggacctgcacctgttatccggagtattcacaccccgttaccggaaggctgcgttatgcctgttccctcacgatgatcatagactttttcgcagtttttccattttacctgatgtttgtcatacccctcagtccatatgttgttcattttctccgcctgttcagactgttcagggttttaaaacttctgagatattatggatccattgatgtgatataccgggtgattaaaagagacagccagtatctcttctcgattatcattatcctgctggtttttctctccttcagctcataccttatttatatctttgaagctgaagcacaacctgataaaatcaaggactttgatgatgctctctggtgggctatcgagacgacgagcacggttggatatggtgatgttattccggtcacagagatagggaaatttttttctttcctcataataattgtaggaatcgggataattgcacttccaacagggattattgcttcaggatttctcgaagaactccgtgcttcaaaagaaggatcatatgatctctctgacctgcatctagcagatgagataaggaaattaaaagagctgctggatgaagggatcatttcagaggatgagttcaggcgagggaaggaaaagatcctgaaataatcgtatatctgatattgctggaattattcgtattggtttggaaaccgataccaataatcgtaagggtttaatgtaatgccaactttctgtacaaatccagaaaatatggcttaaaagatgaattgcattcagaatgcaggctttggattaaccacgggtttccattgattattacaggactttttaccggacacgataaaccggcagattttttgaaactgtaaacatatacccattctggaaataatatggaagaatgttcatcgttccgggagattgacatgattgaaaaacagatagatcctgaacgagtcagaaacctggctgaaacatgggggatcgcggtcactgctgacggaaaggtcaggattccgatctgcaggtatagtgatgtgctgcctctcatcaaaaagaggccggaacgttaaaatttcataaaaactgcctgccatatatcgtgttcctgctctcaaacggatacctatagatgaaccacaccagaattttcgtaattttttccctgatactcataatttcaccagtctcttccctttcagttcatttccttgatgttggtcagggtgatgctacgcttatcaggcataatggccataccatgcttatcgatgcaggggatatggatgctggccctgacattctctcttatcttcagtatcagggagttactcgtctggacgttctggtctccactcatccgcatactgaccatatagggggaatgagcgatattctgcaagcgctaccggtcagtctctatgtggataatggagcgacccataccaccccggcctaccgtaatctggaaaaagccctgataaaaaaacagatcccatatgcaaccgcgaaaaagggtgatacaattcccttcaccgatgatatcactattcttgtcacctctccggatgagctcaccggtgatttgaatgaggactcacttgcccttctgcttacctacggagaggtcaggatcttcttcaccggggattgtgagagttgtgatgcttcatgtgatatcgtgaaacttgcacatcatggctccaagggatctgcgacccgtgccatcctgaacggagatattcctgactgtgcaatcatctcgctgggcatagacaatgagtatcattatccggccccttccacgatcaatgccctgaaaaaggccggggttgaggtattcaggactgatgaagaaggaacgattgttttgaggactgatggagaaaaatactggttcgtctaatatggtcctggcgattgttgaccgggttgaggatgatgtattggtactggtcacccctaccaagccaaatcgggagatccatctcccctgttcactctttcagggaatgaatgaaggagacgtggtaaggataaccgtagagaaggacgaggagaagaggaaagatattgagaaagatatcaaagaccagagaacaagactgaagcgggtaaatctttaatttttctggtgtgggagcaggatctcttttgctcatcattgtgtgagagccctcattcaatcattcctgaatatatggctgcaacgcctgacagaacgttattctcccatttggtatgtcagacatgtgcaaacaattactacccgcccaaacaattaaactttcagagccgaattaaagtatcatcacagtccgactccaaagtcccagtctgacgcatatgattccgattttccattccaaaaccaggaaaagacctccgcggtgggcattggtacttctggctctcctgtgcatcatggcagtatgctgctctcctgctcttggtgctcgagatgtcagagtacctctgactgagctcaggccctccctgttcaccgatgagcagggaaacccggccgggttttttgtcgaccttatcgaggatctggctaaaaaagaaggttggagtgtcatctgggtaagtggtacactctctgagagctgggatcgcctgtcacggggtgatgtcgatctcatgcctgcggtgacggtcacgccagaacggctcatactctatgatttcacaaatgaatcggttctctcgatctggtcacaggtctatgcacgccctgattcgggcatcaataccatccttgatctggaaggtaaacgagtcgcaatggtcaggggagcatccagtggggtgggacttcgggactatgcagaaaaattcggagtaactgccatatatctggagaaggacacagcgaccgatatttttaccgctgtttcagaaggagaagcagatgcccttgtgatgtttaactctgcaggtcaggaggaggtgaaggaatacgggcttgccacaaccccggttatgtttaacccggcacagtttgggtttgcggcattataggggaagaaccaggatcttctcaaggcgatcgatccctatattgcagaaagcaagaagaatccatcctccatctacagcatgtcaatgcagagatggtatagcattacagccgaagagataatacctgcttttctctggtggattcttggaggagttgccagccttgcctctctctttgttatgatgagttatcttctccggcgtgaggtaagacggaagacggctgaacttgccagacagaacgaggaactggttcggaaaaatgaagagttacgagctgcatatgaccaacttaccgcgatggatgaagaactgaaagataacttttatcaactgagaaaaagtgaaagtgcactcattcaggctcggaaaaaactaaacctcctccatacactcatcagccaggatatcaggaatgcattctttaacctggcagggtttatccagatttcaaaggaatctgaatcctttgatgaagcaaagataattttcgagaaggaagagaagattttacaatcggttcaggacaacctctccttttcagagaaatatcagaatctcgggatcaatcagccacgatggcagaattttgaatatgttcttctcagtgccatatcccatcttgatctttcacatatctcaaggagaatagatctgcctgatatcgaaatatttgcagatcccctgcttgaggatgcatttttgtcaatcatggatgcgatcgctaggcaaggggatcaggttaccagaatcgggctttcgtgtcaaaagaacgcagacaccattaccatcatcattgaatctgatggtcagggaataccggcaaacgagaaggagcaggttttcaaatgggaatatttgggaaaaagcgggaccagcctctttcttgcccgggagatactctcaataacggacatatcactgcaggagaccggagaaccagatgcggggattcgttttgaaattacggtaccggagagtgaataccgcatcgtggaaacgaatgagtgagtggagatcctggacattaccacagagaaactttctgagtaccggatctatagccgggctgaaattcgaattatccttatagtgcccaacaaaacgtattggaataatcggtttgaaaaaaaggttattccaagacgtgcattcgaattgcacttcataggaataagcaaaatttttgaattacttcagaaaattttgcattatcctataatcatacatcttttttagggctatgagagataacggtgcttttattacctgacaacatcgtcgtatcagattctctgtgtacaggtgaacaatgaagcggattatccagggaaaggcatcgttctttttctcactacattcatccttattgcagtttttgtatccggtattccggcagatcccgcatcaggtggcgatgctgtcatccctccatttggatgggttcaggtcccgaaactggtctgtgatacctgcactgaaaatccaatggccttgttatataattattcgaatatctcggtcaccagacaatatccaacttttttgcgaaaaaaagtcgctgattgtgataaaaaacaggtgaccggtagagatcccggcatcttcctttcgtcgcaataaggctgccttatgacgcctcattcccgaataagggggccagatcaaccttctgccactccttgtccatgacattcatccagagcgtctggttctgtggctcgaagacaacctgatggttgcttgagtacttcccgcctccgaggtcagaatgacagaactttgatcctccatcctcgatacagacgtcacggatctccatcatcttctctgcatcgatcattcccttcgcctcttctgcctggcggaggaggttgttataccgggagagtgagtgttcagggggctctgggaggttccaggatggatcaacaaaatggtttgcagctgcaataactccgtcaccggtcctttttaccgtccggtcggttgatttctcaagcacaaatgcctcgtccggccctgcaacatccacgatccagccaacatcaggggcagttccgtttattgccgcctccagggcattcaggtcagagtaatcgaacatgaaccggtagtattcagtgatgaattccggtctggtctcgggggcattatcttcccggccacagttatcatcagcaatgaagagtcctttgttgttcatgaaggtctctggtcgtgctccggcagggctccaggtcgcaatgctgttgctgccatccgtggggcggtatatggcaaggacataccattctgtgagcggcattatagaatcagcaagatcccagttgcgggagactaccggggaaccatcggttgtgtaattgtcccaggcggcaaggtatgaacatgatgcaggaaccggttctgggtttgaagaggataataacaggaagattggcccgtaatagaggaatgcaatatcatcataggtgagccctgatgtctctgccataccggtaaagatctcccttacccgctcgggataatatgccggaaccattctggcatccttcatgatctcttcctttgtcattccctggcttgtgatagtgttcatgaggaatgcgtattcttcagtcagttctgttttcataagaccgccatactgacgtcccatctcacgatacgaaccggtaaggacaatgaccggatagagaccagcctgataccgttgtccgtcctcaaaggtggcgatgagagggagatcagtcggcattcaggtgggagattgctcctgctccgatgaaaagacggcagcagtgatggccagcaaacagaggagtaaagtaacgagaattgctttcataatggtatgagttctttttaagtatataaaggggctgatggtagagggatgcaccggatttattggaggatgagcgttttttaattttgtctgattataatttagggagtgttttttgaggatagtatctaaacgatccccgtacacaataatcataatcacatagaaactaaatattattgagaagaggaatgttccaaaaattcaacatactcatagaacctggagaggatggatggtttgttgtaaccgtaccggggcttcctggctgcatcacacagggaaagacaatagaagaagctacagataatgcaaaagaggcaattgaagcatatctggaagcaaatccaaatcatattactcttcaggctaatcaggtttgcgtcagagaagtgcaggttaatgtctaatagtaatgagtaaatttcctcttcttcccgcccggaaagtaataaatgccatgattcggttgggatatttcatcgatcatcagaaagggagtcatgttgttcttaaaagaaacgatggacagagaacagtcgtaattcctgaccttaatgaactggatagagggactctgaaagcaattctgaagcagtccggaattgaaatcgaggagttattgtcggttcttctattgcaataattgattggataatacacattctgatagatagtaactcaccctgcaactgccgaacagagtaactccgcctgttgcatcccacattcgccagatcttttttcaacaatagaatttttcgtactccggcccaagcaatcgcaatatcttcaatagttctcgatccaaattctggatagatgaatggagtgcatcattgacagaaataatacatgacttaatctctctgaatttaaaaaaaatccatttgagcgttggacgagaggtaggtttcttcttctgattcaacaccgtttcatcttcttctttcagcctttttcgcagcagcatttcagtatatgagtaaaccatgaggcagagaaccataaccatacataaagcctcgatccttttttcacttttcagataaacttcagcaacccggaatgatttgtcctttaaaaaccggaaacctttttcgacaagcatctgtcctttatagtgattcagaaccgtttcagaatccaaactcaaaacattcgttgcaagaataaatctgcccagatactgtttttcactttcaacgaaatcctgagcaagttcaacccttgcatcgatcgaatattgtgggattaacgtttctcctgcttttgggcgccccttcttaccattttcccgtttataactgaccttgatccttgaatccaccaattttactaaaggtgtttcattaagatagcgtaagagagcgttattggcatctgtttcacatgcatagcatactttagaaatctgttttaacccttttaatgcggctttgaacctcacagggaggtttttctcaaacgtcttcaattctcgagctttcatctcttcagatgagacaacaatccatttttgaggaacaccaccataatgtgagtcaacgctactgcaagaataccgtggatctgaggtaggagtgaagagaagatcagatttgagtaactctgtcatctcatttattgtggctgggacatttgatatccaccttgtttccggaccgagggttttgatgtttttatcagtatacagggcactgtcacccatgaagattacatcaggatcaaatgtgaatgaatcttgcaatgataggattgtttgcacaagaacttccttatctgattcgttgccatcgtgtgcacgagcaaaaatcggtatcccgtgttggttaaccaccatacttaaggcaaatctgtttaaatcccagcgtttgtcttttggatgtccctttgtaattttgatacatccatctccggattcatttccatattcaccatgaacactgaaattggttgtatcaacatgacaaagctgtactccatctttgtaaacagtaaacatctgggtgacaagatcagtaaagagcttgctggggccatatgcatatatcttatccaaaaggcgaccaatgactgattcatttagattttttgcagaaatatccggacctatgagacgttccaaatcaagatgcttgcagtattcgggaaaaagatagagtcgtctctctgtgaatccaagtccgttgagaatgagggctaataaaatttgagaacttgatatttgatgttgaccaattttagggattgcccggtcaattataggagctaaaccaagcttatggaacgtgcctgcaactattccaagatgatcaatggtttttatggagtctatttctaatgaaacatcctcatctttcattaattatagtaatggagatcttcttagttatatagtttactattatataaaattttaatagatctgacgaatataggttgcatcaccgtctgaatagcattctcctgtttgtccggaggatacccgttcacccggaggattctctttatcgcaacccgcatctttgcccgaaccgattcacgtgatgaccagtcgatcgtaacattctccctgatggtctttaccaggtcctgggctatctttttgagtatgtcatcaccgagaatcaccaccgcactgtcattcacaccgagtgcatcgtaaaatgcaagttctgcctcggtaagtcccagatcctctcctctctgctgagcctccctgatctcccgtgcaatctgcgcaagttcttttaagatctcctgggtcgtgaccttccggttattgtacttgtttatcgtctgctcaagcatctcggagaattttcttgcttcggttgtgtttttccgggttcgtgcccggatctgatcattcagcagccgggtcatggcagcaattgccacattctgatttttgtatttcaggaggtcattgaggaactcttcggagaggactgagatatctccgacatcctttcccatctccttgaagatatcgacaataccaagggggacaatggattttgaaactatctgctttaccgccagattcagttcgtactctgattttcctgctccttctgatgtctttatgatttgtgcccgaacggcctggaaatacgcgacatcttcccggatctcaatggctttttcatgggggagagcaagggcaaaagcctgggagagttcaagcacgtgctgcataaagtctgatttccgttcaggatcatcaaggacatagttgaatcctgcctgaaggatggaaagacgagtcgctgccggagctccccgccagcctgaccagtcaaatccatggaagagatgacaacagacctcgtacttctccatcatcttatcgactatcctctcctggtcaaatacgggatcccctttgcctttactctccgtgtaggtgaccagggcttttttcagttcttcggcaagaccgatgtaatcaacaataagtccaccaggcttatctctccatacccggtttaccctggcgattgcctgcataagagtatggcccttcatgggcttgtcgatatacatagtatgcagacagggaacatcaaatccggtcagccacatatcacggacaattgcgattttgaatggatcttccggatctttaaaccgttttgcaaggagttcccggcctgatttgggtctgatgtgtttctggaaatctttctcatcgcctgctgaaccggtcatgatcaccttcaggaacccctcattgtctgaatgagaatcccaatcaggttgcctctcaaccagtgctttgtagagctccacacagatccgcctgctcatgcagacgatcatcgctttcccttcgatggcatctgaccgctgcttaaagtggcggatgagatcatcagcaacctcattgattcgtttctcatctccgacgatggcctcaagggcagcccattttgtccggagtttctcttttctgatgacttcttcgttctcagtgacttcttcaaactcctggtcaatgagcggttttatctgctcattcatcctgatatcgacgatacggctttcgtaatagataggaacggttgccttgtccttgatggcctgctggatatcatagacgctgatgtattcaccaaagacgtttctggtgactttatcctgaaggtcgatgggtgtcccggtaaatccgataaatgaggcgtttgggagagcatcacggatgtacttggcaaatccgtaacttatctctcctttcttgcttacttttccatgcatcccgtactggctccggtgtgcctcatctgcgatgacaatgatgttcttccggtcagagaggaggggataggtctccttgttctcatcttcggggaagaacttctgaatggtagtgaagacgacaccaccagatgcgacactgagcagtgtcttcagatggtcccggccctctgcctggatgggcgtctggcggaggagttttctgcaccgggagaaggttccgaagagttgatcgtcaagatcattccggtcggtgatgaccaggatcgtcgggttctggagtgatggagtctggatgatctttcctgagtaaaagaccatggtgagactttttcctgacccctgggtatgccagacgactccgcaccggcggtctccgacgtcactgatagctgtctcggtagacctgaccgccaggtttacggcatgatactggtggtatccggccagtttcttgatggtgtttccccgttcatcctcttcaaatacgataaagaaccggatcaggtcaagaagccgctttttgttacagacaccccggatgagcacttcgatctcagggatatgattcggggcttcctgtgctccgtcaatcgtcctccaccgggagaaccgttcaagtgatgcggagagggttccaatccgtgtctggattccgtctgagatgatcgccatggtattgtatgagaagaatgaggggatctcctgcatatacgtctggagctggttatgggcaatggtcagggtggcccgttcatcggtggggtttttgagttcaaagatgatgaccgggattccgttgatgaagaggacgatatcaggccttcggtggtttttcccttcctgaatggtgaactgattgacgacaaggaactcgttgttctccgggtgttcaaagtcaataagcctgacctgatctccaccaacggatccatccttccgccggtattcaaccgtgattccaccggagagcatctcatgaacggtcttattattctgtatgagggtggtatgaccgggattggtgaggatcttctgtgctgcttcatgggcatcacaggggagcgttttgttgagccggaagatggcgtcttcgagtctggacccaaggaggtattcttcaaacgagtttcggatctgatcccgttctccgggtgcgacctcatacccatagaggacctcgtacccaaggtcacgaaagatatcaagtgctgtttcttctacgtcagattcacataatcccgttgttgccatgattgttaccgtttgtcggcagtgatttcagagagatattcgtgtaatacttcttttccagcaggggttatccggtacttctgatttttgcttgttggtctgtccggaatggtgagctcaagaagaccatcttctactaatggctggagaatatgttttcggaatttagtcctatcagttctcccaaaatatgagagtatttcaactaatgtactctccttctggcatatcttcaggagatccatcttctctcttctttgtgctatcttagtgccatcttggtgtcggtcatcttcaggagtctccatcggagtgaaggttacggtgaaaaacccatctgcatcaaagaccggttccgggcacccagattcccgtgctccttccctcatccgctcgattccggtcccggccttttcgataaaccctatccggtgatagaggtcagcaatgatggggttccttctgacgctcttatgtccgagatcggtctgctgcatccccggaggaaggccgccaggacttattatctcaatccggtcagagaagatctggacaaagacgttcgcaccttcgataaaccagtcccggtgcatgaccgcattggtgattgcctcccgatgtgaagccatcgggtattcagggatctcttctcttttcaggccttcgatcttgtacgcaagccgggtatttcgctcgataaagcggagactatcctcgatatcggcaactgctccacctgcgaagtccttccggtcaaggatacggacattggtcgtcccctgaaagaggatgcaggtgatgtatgcctggttgaagaacctccggggatcttttgcaaagaagaggatgccgacattccggaagagaagttttccgcctgatcgctctgttgtttcgatattgacgagaatattttcctggtttccattcggtgatatcccactctgtgagagccagttcgtgaatttttcttcgtctaaatcttccggatacctgaattttggtgatacggagagttcaaacctgatggctccttctttctggaagaaggtccggatctcttcacgggtgagtttctgggtgacggccccctgtcgccagaagaacccgtcgctgcactggactggtttttcagaactctcccggaccgtgatgatggtgacggtgtcgatgtgggtgagaaggatcttgaccggcgggtcacagttccgggcgatgtcctgtattcgtgccctgatgtcattcgtgtctgtgatacccttgaccgatccgtcgtccctgactccgaggaggattttgcctccggttgtgttggcaaaggctacgagttcccgtgataaagcagaggagagagattccttgtactcgagcatggagccttcgccttcttggagcaggatcgagagatcagtacggttcatgtcaggatacaccggtgaattgttcggggttgtctatgggaagttcgccggagaggagtttggggaggagggtatcacgtgtttgcgacaattcttgattttgtattaaattagattttattttcgtaaaaatcgggtttatcaataaactatatgcctgcattagtttttttggtggtaaacatagtgataagggcttaaaattctttttacttatctctaaaaaagtagttccattggcatttcctatgatcaactccatatttgctttaagccattcaaagatgaaataattattacaggattcattcggaattaacgcaataaaaccttgattaattgagattggggcaattgttattgagacatatccaataggagctcttgatgataaaagaactgtaccaataggtaaaatcccagaacttatttctccaacacctaattcagtgattgttctttccgttgataatatgaagggtgttttactatttgacaaatctttaggagtgcaaaacggaatatttccgccccaataagattcattttcagttgaaggagtcgaaccaccttttacttccagtatatctccaatcggtttgatctgccaccctttcgggatctcctgcccctcaacttcttcaaactcgctcggaaacagggccgccgttgccgcatccatcccctcgggctgccgtccttcggccttggcccggaccgggtcgaagtcgatgaaccagctcgtgaagatggcccgggcgatggattcgagggtttcgttcatccggcggttgagttcgatcttatcgtcgagggtgccgaggatgtgggcgatggctttttgggtggggaggggagggagatttatagatattttacgagctgaacctacgttaaaatgctgttggactgcacctaccaaatgggattgaatatgagaatgagtaattgagttaatatagtgcgacaagaagcagtaaatcggattgcgaacccggtttaaaatcggtaacgccacccaatccattctgggcgtccctacctgcacgtgcgtgtttagcaataaacgggtgcgaagctgcaggaacaacgtggtgattcccatagtctctttgggataagctgccagggaaaggtatcatggacaaacaaacgttgaaccgctgcaggatcgttaattatatcaggaggaaagagatttgcccctgtccccactgagggagaatcacggtatcagtagcttgaattatgctggtacgaatggacgaagctgattccggtctatgggcgggtcctaaaataccacaattatccgatttattgaacttggaaaacccaatacgctcctaaaaaaaaaaaaaaaaaatttttttttaggtaagaaccttgtgagaggaaccacatgcgtagtgggagtaggaggctgcaaaacgcgaatgcccggctgtaatggctgtggataggggttcaaactttgccctgacctgaaagggtgccgacgtgcagctggtttttcacggcgaacaggatggtttcaatgaacgggataagttcaattacgcataaaagcgaggacatctcggacagaaaacttgcaaaacaatggaagaaatttccatttgctaaagcaagagattatgtaaagcgacttcagacacgtatcgcaaaagcagtgaagaacggccaatatcgacttgcaagacgactccagtatctgcttacacattcgttttatgcaaaaatgttggcagtacaacgagtaaccaaaaacagaggtaaaagaagtgcaggagtagatggggaaaaatggaccacccctgaacagaaaatgaaagcagcattaacgctttcggacaagggctatcgggcaaaacctctccggagaatctacatccctaaaccgcaatcgagtaaaatgcgacctctttcgattccaaccatgtatgaccgtgctatgcaagctttgtatgcaatggctcttatgccttgggctgagaccacagcagacaagacatcattcggattccgaatgaagcgaaatgcacaggatgctgcttcatacacttttcagtgcttaagcagaaagacttcaggtcaatggatattagaaggtgatatccgcgggtgcttcgataatttcgcacaccaatggatgcttgataacatccctcttgaccaaagaatccttaaccaattcctgaaagccggttatatttatgatggaatactctaccgtaacaagtcaggtacgccccaaggcggcttaatttcccccttattggctaacatggctcttgacggcatggaaagaatgttgaaagaacactttcccggaaataaggttcatctcatacggtttgcagatgattttctcgtaacggcagactcacaggaaacggcactccagtgcaaggaactcatcactgaatttcttcatgaacgagggcttgaactctctgaggaaaagaccaaaatcgttcatatcaacgaggggttcgatttcctgggctggaatttcagaaaattcaaaggcaaattcctgatacaaccttcgaagaaagctattgccgcaatcattgataaagtaagggtaatcattaagtcggcgaaggcctggaaacaggaagaccttatcaaagccctaaatcccgtaattaagggatgggcaatgtatcaccggacggtttctgcaagtatgacctttgggaaacttgactgggttgtccgaaatatgttgtggagatgggcaaagcgccgtcataataataaagggaagagatggattgccagaaaatactggcacccaacacttaccagaaaacaggtctttagaacctctactcttactctcgaaaacttctccaacaccaaaattcaataccgaaaattcataaaactggatgcaaatccgtttattgataccgagtattttgaaaacaggccaggagttttcctctcaaagcaaagatcgatacggatgttccttcactacgcccataaaagcgggtagtgaaaaacttgagcggattgcggtgaaaatcgcacggtccgttcttggaaggctgggttagggtaacctaacctggctattcgacatacaccaaaaaacgattagaaactgaagatttaggtcggagaattactacatcggaacaatttgaattgtgaaaatcatgtggaataatcgcacaggctccaggttcgccagttcttacaattacaatatcaccactccgtagcgatgatttttttaatttttcatggaattcaggtgaaatatatttcaaatcttccttaatgattcgaaatggtttaacgtttaaggaacgaaggaaaggaatacctgagtctacatactcatttgccattgatccaacatggccaacagtaatatcatcacataattcttccaaattcactttaatccaatcatttccgtaattattcatcattcctcattgatcagggttaaaaggacttttgataaattttaaaaatttttgtcctagaattgtagtccttctccgttggttcgttttagggttgatagcttcatcaggtaacttatcttcgtaaattaaaccatcattaacaagatctttctctattttataagataattcaaaattatttttaaattcaggtattaatattgataaatcacttttaattagagaacctgaagaatgtacaagtaatttgtgaacatctcttgaatgaaattcatccattttttctaataattttaaatgtaatggagtatatctatctattaaattgaggaaaataaattggatgtcatcctctaagggaagatcagttgctgaattaattacagcatttcgcaatgcttcgatcttttccttttgatgcgttctcattgcaatatttgtggcatacaacaagacactgatgaattgctcattatccttgagattatcaattctaaatccatcaatttctgtttctaacctcactaactcttgatatattattcccatccattcctcgcgtctttttgataatggtggtgcaataatcattgagaaaaattctgaaattggacctccaattattggaaataaagataaacccgctttcactcctgcatgtgcataatcgctataacccggtttcaaatcctcatggatatctttcccttcactcatcccggataaccctctctacaaattcccggctctcctctgtccccggcagtctgacctgatacttcgatacaaacacctgattatctattccggcacaggcatattgcacaagggcatgattctgggtagtacacagaagtaacccgaccggaggattatccccctcggtcataagatgagccttgaaataattcagatacgtattcagctgccccagtgcctcatgcgaaaacccgccggtcttcagttcaataatcacatgacacttcaacacccggtgataaaacacgaggtcaacaaagaagtactcatcaccgatcagaatcctcttctgccgagcctcaaaacagaacccgtacccaagttcaagaaggaatgactcaagtttgcggagaagaacctgctcaagatcagactcatacatgacctcctcacttttgatcccgagaaaatcgaacacacatgggtcgcgaattatgaggtggggtgaatctgtctgtgctccggcttgaacatgttcagataatgcttgtttatcctgtgaaagagcggatcgttcaaagtacagactctcgatctgtcgtttcagttctctgaccgaccagttccccctgacacactccacctcgtaaaaccggcgtttcaggggatcgtctaacggcatcaggagggtaaaatggctgaatgagaggttcatcaggatatcatcccgcccggcattcatactctgaatcgggatttcctcgccgcatggttgcagaagatgagagggattgaatgtggcaaacaatgattgccatttttcaggacctgcagattcggcagacagtgtttgccaaatgttcggatataccagatagaactggcgatataatcggagagtacgggctgaaaatccggaagtatcagacaaacgggccgctatcaggtcaaggagggattcaccatataatgcccgatctgacccatgttgctcgaattcacgtatataatacccaataagccagtttcgcagggtcagtgatcggtttaccgcttttacagcctgctttgtgagctcagtattgacctccgagatgcaatgaaccaggtctgaaaaatccatctagcgtcccaccttctctgaataaatatcctcatcctctttcccgaactgattctgtgccctcttcatcgcactcttcagtttcgcctcaaggagttccctcggcggtagttcagtcaggtattcagcaacccgtatcccactgtccgaaagcccgagcagctccacatgctcagtagacttcccggcacagagaatcagacccatcggtgactcttcacccggaacccgttcatatttgtcaagccaccggagatacagttccatctgacccttatcagcagcctgaaactttcccagtttcaggtcaatcgcaatcaggcaccgaagccggcggtgaaagaagaggagatcaatataataatcctctgcgtcgatggtgattctcttctgcctcgcgataaacgagaaatcagaacccatctcaagaatgaaccgctcgatctcccggataatacccgattcaatatccttttcagagtaggtatcagaaagcccgaggaaatcaaggaaatacggatcccgaaagaccaggtccggactcatctgatcctctttccggagagcttcgagctcctgcctggctaactcttccggttttcttgaaagggctgtcctctcaaagagcatgccctggatcttctccctgagatgacggacactccatcgctcaatccggcacatctctgcataaaaatccctttgtaatgaatccttcagaggaagaagagctacaaaatgcgaccagcttaattgtcgtgatagtgtcgtgacaatatccttgtcaggaaaaagttctgaaaactgaatcatctttcgaagatttttctctgaaaaaccagttccatatcgggtaaccaattctcgtgacagtgtcacgacaatgtattctccatacgaggctcgatcatcatgaagtatttcggtgcgaacactgctcccaatactccagtacagctgaaccatctcgtagttgatacctgaagcaatccgaagatgagtcttatcaatatacgaggataactcagttagcagagcagagattcgctctttagaaatctcatcaaaaccggacaggctcttgattgacttgtctgcctgctttctcatatggtgtatcctaagccccccagattcttcttaatctcctcgtcaagccgggcaccatcctccatctgttcagataactgttttgtcagccgggtcatcttttcagcaaacggctctccgtcatcctcggcatcttcggcccccacatatctacctggagtaagaacatgcccgtgttttgctatctcctctagggttgccgaagcacaaaaacccggtacatcctcatattccccggcactcgcatctccccgccaggcatgatacgtcccggcaatcctctcgatatcctcatcggtcagctcccggtgggtcctatcccgcataacacccatcttccgggcatcgataaagagcacttcacctctccggtccctgaacctcccgtttgatctgttccgggcaacaaaccagagacaggcaggaatctgggtagagtaaaagagctgaccgggaagggccaccatgcagtccacaaggtcagcttcgaggaggttctttctgatctctccctctcctgactggtttgatgacatcgatccatttgccagcacaaacccggctatcccggatggggagagatgatggatgaaatgctgaatccaggcatagttcgcattcccggtcggggggataccatatctccaccggacgtcatccttgaggttctcccctccccagtctttcatattgaaaggaggattggcaaggatgtaatccgctttcaatgttgcatggagatcccgcctgaaactatccgcatgttcagccccgagatcatgatcaatcccccggatggcaagattcatctttgccagtttccaggtggttgggttggactcctgcccgtagatggagatatcaccaatccggccaccatgagcctcaacaaacttctcactctggacaaacatcccgccagacccgcagcagggatcatacacccgacccttgaagggagagatcatcgcaacaagcgtctgaacaacacaacggggcgtatagaactgaccgccgttcttcccttccgcactcgcaaactcggagaggaaatactcatacactctgccgatgatatcctttgaccggttttcagagtcgctcaggttcagggttccgatgagatcgatgagttctcccagtttctccttatcaagaccgggacgggcatactccttgggaaggatgtttttcagaaccgcattatcccgttcgatggcatacatcgcatcatcgacgatcttcccaatctccggacgcttcgcattctgctggatataggaccagcgtgcctcctttggaatccagaagatgttctccgacctgtactcatccggatcctcaatcaccccgtaccggacttcaggttcagcaatataccaggtgctctggggatccgagtatgcctgctcaagcgaggagtgcttctcttcaaatgcgtcggaaagatatttcaaaaaaatgagaccaaggacgacatgcttatactcagccgcatccatattgttccggagtttatcagccgctgcccagagggttgcttcaaacccaagatttgctgcggttgtttcctttgtctttttcgcacgggccatattcagagattagagggttaatcgtgacaaacgatatatgttttcaaatactggtgcggcctacatagatactatggcaatctggatagcatcagggaacaggcagaactgggaggttgtgaaaaaacacaacatatggggtgttccaaagcgaagcaaaggacttcattcgagggtaaaaccaggagatactattctcatgtatgtcaggtccgaaacacatggagatactgtccttccctctgctatcatgggagagttcaaagtaaccgaactatttgaagatggaaaaccgctcttcaccgctccaccccagatgggtgacgagggatttccataccggttcaggctgaaaccagtgaagatattcaaagagccggtggagattaaaccgttaattcctgaccttgggtttgtgacgaataagaccatgtggtccgggcattttagacaggctatgcgggagatacctgacgaggattaccggaaaatactctctgccggaaaataaattatcaatatcctatcagaaatgaatatgaaatctgaaggaaaccgattaattctagaaatattatgagatttttctttaatgggaattatggatctaacaaataaattctccgaattataaaaagagacatctattaaaaaatcatgtcacattggaaattcttctaaacaaatttagttcaatagatgaacaagatgactagttagagaaccttaaccattactaatattgtcctcctaaaaaatcgattctggagaaaaattgtgaattttatgatttagtcgtaaagagccataatctgtatcgattaaaaactacattcaataccattgattacatcaaatcattcaattcattaagagattttgaatatacactgttttttgggtcaagatctaaagcagtcgtatagtataatattgcttcttgggtttttccctgtttatccaatgcatatcccttaacataccacccatgagcatttttactgttcagtttaatcgccatttcggcagcagttattgcatctgaatacttaccgatattatttaatgcagcaccttttactgaccaaaaatattctttggtgggggcaaattctattactttatctgcaatttcaattgctttaatccattcttcagtagaataaagataatctatcgctttttcatatgcctcaatggctttttctgtctctttaagttctaaataactatttccaatattataccatgcataatcagcataagaatattccgggtctatttcgagtgcttttttgtaagcctctatcgcttctttatactctttaagatgatacaaagcattacctttattataccatgcataggcaaaatcggactctgtttcgagtacctgttcaaataaatccaacgcttcatcataatgaccatcgtcatacaaagcaatcccctttgtcgttaattcggctgttgtttctgctacacacagagatgttccaccaagagtcacagtaagaacaaccaaaaacagaaaagagtaagtggtcttttccataaaaataataaggggaatctgcatatataaatatgcatactaatgactaatctcctaaatgggaacttcaggagcctttgatctaatgttccaatcaaacagaaagaaaggatgaattacagattttttgattgaattgtccataaataacatgtaaaattattgtcagctttgaaagaatccaataaagaattaattacagagggtgttgcatgactaaaatttggaaaatttttggtaagtactttttcttatcaacatctttagaaaattgtctccgatcattctgcccaaagatgataatgcatcggacaatattgaataaggtattctaatacccactcccttattacagataatatgccgcttcttttgcaggatcagttctctgaatttcttcaactcccctcttgaacagaccttccgaagattctgtgttaaacaaatcaaactccattcatcctgacaatgtgatattccccttctctgcaattttcttaaattgcgattttctttaatccatccaaatgcgggttcaacaatcgtttttcgttgtgaatatgtctttttggcaccatacggagtcattgtcacttctataatccctttagcaatagaagcgggtgttggaatattatcatcttgaatgagatttctcgtacaccaatcaccaatagatgctaacgttggaatactgcaaatgccatcaaaaagttgatcggaaattcgttcaagttcaagtaaacttctctcgaggcctctaatactgaaaatatctggttcatggcatgtagaacagagaaatccaatatcctgctgtttcatatacagatagttttcatagctccaataaccagcatcagtaagtaaattaagatattcaagcgataagccggttaattgagcaatttcctctaatctttcataacatggttgaagtaatctgtaatcaacgggtgaattacttaaaaacggaaccagaatatagccatcctggtttacaattatctggccattatatccttgaatacaaccaggcccacttttcattattgaactatcaggatctgtagtgtttgcaagactttgttcatcagggttttttgcaggctttttaggttttctacctcgtttcctttttccagactctctctcctcttcctccctttgggcaatcttctcttcctttttttgggatttctccttatgttcagcctcaagtcgttcttttgcttgaatgaatcgttttatcctttttgagtgagtcttaaaatcatcgggaacctcgttacctgatttatccgggccataaagacgatcctcgacatcatctttttcttggacttcctttagatatttttgaatttctccctcaatcttttcatatggcatgttcgatccaagtgaagcattcgcctttagttttgttccatccaaggcgagaaggacgttattgattaatcctgcttcattaaggagagtcaatactggaatgaaaagttgtccaataaaagaactgtttttcttgataaatcgcgagattgtggaatggtctgggagagaattgcgggttactattctaaatcctacatcgtatctgcatttattctctatttgacggcttgaacgaactccattaaaatatgagtaaatgatcaaaccagtcattatttctggatgataaaatgccgcaccttggccgtcttcccggtattccttatataatggggataggtcgagaattgagattaaatcaattaatatatgacagaaatcatcactcggaacccagtctctaatatcctcagggagaaggtaaagttgttcaaaatcccgacctatcgtattatacattgagtatatgttggacgtactaaggtaaagtacttttgattgaccttagttaaaaaattatggggggatctgagttgtgcaacaccctctacaatcggtttttatttatacacaatgtaacaacgcttataggatcacagattaacccataataaaattaaaaatttcgacttattctccattttcactccaatatccctgctcctcaaccttccggataaaggtctcctcatccggaatcctgttctgaagatctgtgacagattcccgcaagcgggagagtatttctcgtatcaactctgaatccggctcatcaagaagatccatatccgcaatttggtcaagctcatcccaggggatggtcgggagtgtcattctcatctccggagaaacgagctgtgctattcgtgaaaggcggattacctgatacaccaatccatcatgaattaatcttctggataccgaatcaggagcgttttcttcctcgttgttcacatatacccgttcaatagaacgaatatagagcagaatatcaagaaggtgcgagatctgccggtaggttggctttaagttattcagcatccctatccggcggatgtagttttcacctgcctcaacctgctttctatcagcaatatccacctttctctcaaagatcttctccatctcttcgatcatctcatggtacgtaaagagatccgggtgaaaccctgactcatacgtgatcatgatgtctatatcactgtcaggccggagagtccctgtgctggctgatccaaaaaaggaaaacgtggagatatgatgacgtgtgcagaaatcagtgatctggtcttctgtaatcggaagcccatcaggaataatcggccgatgtatcaatgtcatgttaattctccatttcgggaaacaggatatatgcgcaagagtggtctgccatatcacatacacaggggaaagagatatttctccccggaataccccgctcataacgaaaagggagcagggttcaggtaattaccgactgctcaactgcccggagagagggaaatagaacgtcaccaatgcaaagaccaggaggtagatgaacgatatcaggatctccgtgctgctatagatgaattccagcccaagagcactgaaatgatcgcccattgagaagtacctgagcccgtttgagaggtgggtcagtggatttatgagagcaatctcctgcagaacggggggaagtcctgccgatggagagagagcattagacgcaaagaagaccggcattgagagaacagtcgtgacgccctggtaccctttcgatgatgatgttttgaatgcaacatagagtgagacacagagcaccgctgctgaaaagacagcaacaaagaggaccatgccgacgagtgagatgagcactccaccaaagttctctccggagaagaacgtgacaccaaggactatcccgaagacgatgatgataaccgtctgaatcagtgactttgtgactgatgagagggatatcccgatgatcagatcacgcctcggcattgggctggccatgatctcccggagaattccccaattcttgtcaaagagcactgagaatcccccgtacagattcgcaaagagaatggtagcagcaatcatccccggacacatgaaagtagggtaatcataggagatcatcccagccggagcagaaccacaaccaagaatacgttcaaaatttcctgccatcccaagaccgaagagagcaagccagaggatagaatgaagcatcgaggtgaagagttgatccttgaatctgacataccggcgaatatcccgtttgaataccgcaataaatcctgaaaccatatcgatcactgttagtcccggatctccgttccggtgaagtgcatatagacatcatccatcgtgggtttcttcagactgaccgtttagatcttcttgatcttgtttgtatcggtgactgtcagatttacgtcaacgagcagtttcatctcgagtttttccagaactttatagatgcatggtaaaaacaggaaattatgtaggtatcaatgggcataatcaatatcagaagttaaacaatagtccatgaaagagttggataaataatgtattatcttgattccaatatggtcatctgtgcatcaggtgactctggaaggtgattggtgtagatctgttatttccaaacaaaatatatgagcaatatgaaaagttaagaaataaccgtaattcgcaagaacatttttaagaagaatgcgagggaagcgatttgaacgctcgaacgccttcgcgacaaggccctcaaccttgctcctttgacctggctcggataccctcgctcaatgaacaataattgcaccgtattaccggagatcagaatgtatcctgaacatcgggtctctgtgcctgaataaggtcgatgtagtacgtaaagaacttatctattccactcgcggagaagacccactgtctaataccaatgaagaacagaaaaagatctatgtggtctgcgattctcggttggtttgaagattccccgtcacaaacacgggtcgtcaggtttcttctcgaaaacggattcggagtaaatcaggacgggaaaatcgcatgtaataccatcgcggtggcagcgacgcaggttgccgccaaactccatgttgaccggagggtcgtcgaagccactgcccgccgcatcctcacctcaccctttcgggacatcttcataaacatgcgggccaccccggatctctccgtcattgctgagagtctctccctctctgtcatcaccgttatacctcaggacgcgagcaggccgggtatcgtagatgcctgcattcacatactctcatcccacaacataggcctgcggcaggtttttgtcactgatccccacctctctgaagagccgcgcctggttattatcgctgaaggaaaaatgccccccggagtcatcgatgagctcagggagttaccggttgtaaagcgactcattctatgaagattctggatcaggcgttttcagccgctccagttcattcgccagtgcaagaaaccgttccctgatcggctcatcaaaccgttccaacgatgatttaaactcttcatcgcttatcacccgggttcctttcacgaggttatcagcatgagccacaatcttctcctccagcgtttcaggaatccgatcaacagcagaaagcccgaaccctgcccgttcgtcagcctgaagaccggccccgatatgccgctcaacaattcggcagagaggctcatcaaacccaagtgaccggcagataatccctccttcatcagcatggcccatcccatgagtcctggaccggccgatgtcatgaaggatcgctcctgcagcaactaattgcgtgtctactattcttcctgcaccggtaatgtcagatgcaatccggacagcaacatcacgaacaacacggcaatgctcaatgactccgggatcacacccggcctcgttaagaaaagataaatattcgtctcccggactacacatgaccgagattctcttcaatacgtgcaatacgtttctgcagagcattcaccagcaggtcattgtcaaaatgaaccatcttgttttcacattcctgacagacaaactgtgaatccattgcatccgaaaatgtgatggtgtttccgcagttcggacagttatagaatgcgttctcactctcgtatttgtaccgcttacgaagtttttccagaattatctcaagatcctttgagactgaatcatacatattgtccagttcaagttcccagagataggtcagccagccggtctcattattttttattctgcgatattttgccagccggtgttcatacagagtgtacaaggtattccggactgagttcaggtttatctttgtgacctctgcaagttcttcatcactatattccttatctgtcggaaaccgtcggatgagttcaattccctcatccccaatcattcggtgaaggtatgcaaaaatagccttgtcagccagtatctcctcgtgggaagccatcaccgtatatattgccccactaccctgatagtagtatccagtgctctttgtgcagacgctggatcaggcccggatccatacacgctgataaccgcacttccttcttcaaatgaggcgggggggacaggaatgtcggcaactcccggagcaaggaaggagagatcatccagaacggcgcattgccggtcagcaaacagaatccggcggagtgcatactgctttggaatcggcatcgcatcaggcagaactccctgacaggcatccaggtgtatttgtaccagatttattccggtagcagcctcgatggtatcaagggttgcaacaaaccgggggttgagctcaattgcatagacctcgctatcgctgaccatgaaatcaatcccaagaataccaagacacccggacgctgctgctgctcgttctgcataggagatcatctgatcctttagcggatggtcaaaaggggtcagagagccggcgtatccgaacctgtactggccttcaccccggagaatctgacgatttaccgcaagtgcctgtgcccggccacatccggcaacaacacagaccgatgcaggaattccctgcactatcctctgcagtaggaacggctcatccggaaaggcctctttccatacatcgatatccgcctgggaactgactacggtattacgccatccccctgaaccggagagtggtttgagcattgccgggaactctcctggccctgcaagcggaggaaccggaatagcaagttctgagaaccattcctgcacaaaccccttgttcagaaactgtcgcgccgtatgagcatcggtcccgaagaccggagcgggaagattctcaagtgtctcagccccggaagttggaattatcgcatcgatggcatacctcccgcatatatccctgatacagatggggagctctgccagctcctcaaacggcatgcagcagaccgtatgtttccggagatcagcatcacagaaatgatcaaccgcacagacctcatacccggcccgactggcagacaacacaacatgccgggtcgagaacccggccacgagaatccgcttcagagttcttccaccgtctttccgcatggattcggaaacacccggaccttggcccccggaaactcacgatggagtgcatttggagcgatatgatcaaggaacaccgcaagccctgcaatctcggagtgcggctggttcgtgaccgcaacgttataatctgccatctggtagagatcccctggaaccttttctgcaccgacaatgaccaggatcttctcctttgtcctgatctcctcctcaacatcaggcaggttcaggccaaacatggtaagatggaccacaaccccgccatcctgtttccacctcttaatacacgaattccacccgaccttatcttcgacaaagaactcgccaccaaaccggtcggcaacatcccggatacttgtcacaacaccgcggtcatctgcagcaatatacatcccgtctgcaccaagagcccgtgccgtaaggccaacatgggtggtaacccgcatatcccgctggggccggtgaccaatcctcagaactactatcatttcttctcctctccggagggcctgtacctgattactccacctgataattcaagcccgtctgaaaatatatctgccatctgatgtctgagcacaatctcctccgtcgagcaggcacgccaggcattatcccgaatatccacgagacaataccgcttcagccgcgccagtgacgcattgacgatatcctgggcatacccggtctgttcaataagtgtctcacaggtacaccctggatttcctagtataagatgatataatgtccagtcgatatcctcgtctctcactattcccacatatttactctcaactgccatgagtacttcccccggataattaccaactttgttgaagtcacaggaaaaggtatgaagatagcattcaactctgatggtatgcacagtcacgcacgtatcaccggcctggtgctcatcctcctgatcaccagtatgatgtccgtcagtgccacggagacaaaagacgatggcatcccgctcattcatgtcaccggaagcggaaccatcaaggcgacccctgaccgggttcagattgaactcaccgttgtgactaagaatccggatgtaaaggcggcacaaaaggagaatgcacggaagatggaaaccgtcatgtcagcacttcgtgatccctccaaggggaacctgaccggacgggagattggcactacctcttactacatctctgaagtatactacccggatgacaccctcaaagcaaaatacggcgataatatcaccatctaccaggtatcaaacaccatctccatcgagacagagaagattgaccgggttggagatctcattgaccttgccgttgcagcaggtgcaaactccgtaagctccctgcagtttaccctaagtcagcagaagaccgcagagcttcgaaaagaggcacttgccatcgccgtgaagaaagcacaggcagatgctgagaccgtgatggctgccatgggcaagtcacttggagatgttcacgaagttaccgtggatgaaagttaccagccgccggtctattacaaccaggactcccgatctgtgcagatggccgctggagctccgtcaactcctatagaaccggggtcggttgaagtaactgcacgggttaccacaggataccggatcctttgaccggaaaatccatacctggaaaacccataaacccctttttctcacaggtcttatacgtaatatgaatgatgaacccatcccctttgcagtactctctgaagttgtggatagaatcctcgaggactgtgacgaggatgttgtctgcacccggatgcgccttactgcccttgatcctgcgatgagggatgctattgtcgtttctgatctgctcaatgcctggcaggtcttctattacttcttccaggagcagccttttgacgatgcatttgagattcttgcattcacgccggcatcggtgttgccgcaggggatatccatcggtgaataccgggaatgcactctcacctttgcggtaaccaacggccggccagttatcatcgtctctgatgacctgcaggagatgagacggttttccggaccacatgcataccaggaagcaatcaggtttatcgatactgaagaataaaaaatcaggcggaaaatgccctgatgatatcctcaggacttccaaggaccatcaccaggtctccgccacagagcatctcatctccacccggactgaccgtcatctgttgacctctccggatggcaacgatcgatacctgatacgtactccggatcatcgtctctttcagcatttttccggcatattgtgaatcttcagcaatccggattgtccgcatctccacgtcaggcactaaaacccgaagatcatcaaacgagtaggacggggtgttaatactccggagcatctggtatccacctgcccgaatctcactgaccagccggtcaatctcgcttgtcggtatcaggtaggtgtataaaatcctggtaaagatctcaaccgccgtctcaaactcctctgggatgacctcatcggcaccaagatccataagggtggcgacctctcccatgtacctggtcctgacgatgatatgaatagccggattgagcatccgtgccgtctggacaatctgctgggttccgaagggatcgttgacgacgataaccagaacacgggcctttgctatcccggcctttttcagcacctcaccctgggctgcatccccaaacataatcggctttcctttcgccttctcgtcccgtacggtatcaggattcatctcaatgattcggtacgggacaccagcgatatctgctgatcttgccacgttcttcccgttcagaccatatccgacgatgatgatatgatcctccggcccctgttcttcggtctcctccacatggctccggtcgggcataatccggcagaggggagaggagagcggggctgcaatctttcctgacagacctatgagaagcggagcaacgcccatggttacaattgacacatcaaggaagagctgaaaggagtcctgggcgaaaaatccaagcgaggttccggttgtcgcaaggacaaaggagaactctccgacctgagcaagggagataccggtcatcacacaggccctgggggcaagacctgccagcagggatgcaagagttccggtcgcatatttgactccgatgaccagcagaaccagttctgcgataataagcggattttcaatgaagaactgaaggttaaagatcatcccgatggaaataaagaagaaactggtaaacagatcccggaacgggaggatactggacatcgcatgggtgctgtactccgactctgatatgatgataccggcaaggaatgcaccaagggccatcgacagcccaaactcactggtcaggtatgcaacgataagacaggtccccataacgatgaagaggaacatctcacgattcttaagcctggctgcatgaagaagaagggccgggaccacatactttgcagcaacatacaccaccgcaatgatcacaaaactcccgataagaagccgggcaagggagacgtccgtatctgtcgtgccggcaaggaccggggtaatcatgaccatgggaatgacgatcaggtcctgaaagatgagaataccaagtgttgccctcccatgaggactatcaacctccatccggtcagcaagcaccttcatcacgatggccgttgatgacaaggagaccagcatcccccagaagaaggcatgggcaagatccatcccggtaatctgcataagggcggtgaagatgacaatggtagataatacctgaaccacccccccgataaggacatatcgccttgatttgaagatccgtgatactgaaaactcaagaccgatggtaaatagcagaaatataaccccgagttctgcaaaaaaactgatagactcttcattagtgatgaggccaagaccggacggtcctgccagaaaccctgcgattaaaaaggcaacgactgatgggatcttcacccggtacaggacgatgaggaggaggacggcgatgagaaaaaccaccacaatcccggtaaacagagttgctaactgcccttccatgaactgacctatcatggcacctgataccactaggttcttttcatcatacggcagatcatcagaggagcatgcagcatggtgaaggacggatcgccggtgcagcagatatcgggggaaccaatacccgtgtcggcctgattcgtgaggacggaaagattgtcaggattgaaaaatttccaacgccggtcagcgggaacgcagaggacatacccctggctattgcccgggccctcatggatattgcaggagatatcccccttgccggtcttggcattgctgctgcagggccgctcaatatcagggaggggatccttgaccatcccccgaacatcccctttgacttcgtcccgattgttgcccccctcaaagaagcaaccaaccttccggtgatattccaaaatgactgccgggcagccgttctgggtgaggtctgtgccggaggggccagaggatatgaaaccgttgtctacatcaccatctcaaccggaatcgggggcggaatatgtaccaatggaaaggtcatcaccggccggggaggaaacgcaggggagatcggtcatttcccggttgatacgacgtataatctcacctgcacctgtggtctttctggtcactgggaagggtatgcttcagggagaggaattccattctttttcagggagtggtgtaccgcacatgatcttccctgtatttattcaacgacacccgaaattctccggttctcagctactgatccccgatatgctggatttcgggatgcccttgcacaagtgaatggccggggactctcatcggtgattgtcgcctatgatcctgactgtatcatccttgacggaacggtcatccagaggaatccagacctgcttgaccaagcacttgtctatactgaccggtaccttgacctcccaccctgcatattcagccccctgaacggagatgcaccacttattggtgctgcgatggccgtatttcatccgaagatgatttaaactgatttaataaagctggaaaagctattgaagattacggaaaaaccgatgagggcagcacacatttttgtccttctcctgctactttggataactccggcagggatgggggaagaaacacaggatgacatatcaccagcacagacacataacctccttgtcatctacatgatagccggtgatctggagacagaaacacagtcagcgaccatgaatatcgcggaaattcttgacgggtatggcaagaccagcgaacaaaatctccagattgttcttgggtatgggggatcaaaaacgccaggatttggtgggattacctatgtcaccgtcaaagaactgatggaggatgcatcagacggtgtgatcggaaatactgaggatgtcttgtatcatgacccggatgcagacatgggtgataagaaaacccttgagcacttcctctcatggatcggagagaattttccatctgaccggaagatccttgtattctgggatcatggcggggggtatgacggatttggtgttgatgaggtcaccgacgggcagctctcactcacggatatttcgcaggcacttgaggcatccggcagtacatatgaccttatcgggtatgacgcctgccttatgggagcgcttgaagttgccaaagccatggaaccatacggaatactcctgatcggatcagaagagacggaaccagggaccggatgggagtatgaaacctggattaaagctcttggggaaaaccctgaaattggatttgaggaactggggcagatcatcgttgatacatacatgaacagggatgataccggaaaaaccctctcggtcatcgatcttacaaagatccctgctctcattcaggcattggaccgccttgggaccagtatgatgccctacaccgagtccattgaaggataccgggttgttggaaaggcataccaggtacctgccagatatgggtcagacaaccgggaagggggagagacatcagtagacctcaaatcattcctgaaagctatcgggaaccagacccctgaccttgctgatgagatagcagtcgttaccacgcgtattgatgaaacggtcctgtaccaccggaatgatgagtatgtgcccgaatctggcggactgtctattatgtccccgagccgtatcacccctgacctgtatgaggaactgggtgatgatgcacggattactccggggtgggactcgttctttgtaaatctcctcgagatttcaggccaggacactgaaaaaccggagatcatgagatctgattcggggtttcttattgaagatccgacaaacaccgcatccgtttatgctgagtattactatgctgacggggacgaactcattctactgggtaatgagccacttgaccctgatgagaacggcgagtacaccctgcctgagtgggatggtcggtggtactacctgcaggatatgaataacgaagacaactatgcactcctcggaatgaactttgagtccattgggccatcaggatcggtgttgtatacgtcagaaattgatctgatcagggaatcactcaatactaccgcggtgctgaacgtatatatcaatccacagaccggcgagacacggcttgttgcctgcccgtatacaatccggccaaatggcattattcagttctcacggcaaaaccttgacttggaaccgaatgatacggtgtattcatatgcatggaaagtggacgaagataccgaaaccggtggagagtgggttgagataggtgctctcgttatatccgggaatacaaaacttatttatgacatcctccctgacggcacctatgcccaggcactctatgcagaatatgggaacaaacctggtgactatgcagggatgcaggtgttccagatagagaatggcgagataacactcgtggagagtgagacaaatatcaccgcactgcaggaacctgaagagaataaccagtaatttaatccattacacaggtaatacagggaagaacatctccctgatatgcctcattttttttatcatatcggcaatttccatccccgcagcagctgatgaaaacagcaccctgcttatcgctctctatgcatctggtggaacccttgagcagcatatggggcttataaccgatgattttacacaggtggtaaaaggtgctgaaaatctatcagagcggataacaattcttgcagcatatggtggtgcagacaaacccggatggagggggatgaccatcgccgggcttgacgacctgaaagcagaccttgcagacggggaacttggcaacagcaacctgtcaattcaaaaggtccgcaatgccagtatgggtgatcctgaatcactcgcatttttcctctcatacatcaacaaaaagtatcagtatgaccggctcttcctcatcttcattggccacgggcaggcatataccgggatgctctttgaccagaaccatggcgacgacgggctgaccatcgacgatctgaccaagggccttgggtcatgggatatcgaccttatcgggtttgactcatgtatgatgggatgccttgaggttctctccgctctctccccgtctgcatcatacctgatcgccagtgaagaggcagaaccggcagatggctggccatataagccttggatctcgtatatcagtgcacatccggatgaatcggtggagcagtatgcaaaaaatctcaccgacgagtatatgaagacccccggtcagggaaagacaatcgcactccttaatccaaaagaggctgattatctcaccgagcggctggatcggtttgcaaaagaccttcatgcccttgccggagatgaggagggatgcaggactatagcccgcattctatcacagacacagcaatttggccgcaccggaaccggagaactccaggagacgaccatggatctgtattcctttgcagatgaggcacggcttactgttccctatctctcaaaatctgcagaagaagtacgtgaagggataaaccggacggttatttttgcccgccatgatgccatggtccctggtgcacacggagtagccatcctctcaccagtcctcatcaatcctgtattttacgaatattaccgggaaagtgcattcattactccgtcatgggacagatttcttatcaggtacctgggagaatgtggagaagacgggaatatcaccgctctcttctgaccaggagcagacatccggtgataagtccgagtagtattgggaagattgtgagcggagtctctttatgagtggattcaagtgcattaatcttcagaaggatcccggtcaggtttggctgtatctccatcgcttttcggtaggcatgctccgctccaggggtatctccggcaagtgccagcacatccccatactgctcatacacaaaccctgactgctgatcggatccaagaacgtcccgatataaagccagcgcttcagcctccctgcctgcccggaccagagtcatcgcttttccttttctgacaaggttaggatcagattcattcagggagactgaattccagacatcaagagcatcctgataccgccccattttttcatatatctcggcaagccggccaagcagggccatatttgtcggatcagcggcaatggctagctgcagggattggagtgcagtctccggatcgccggttgtcaccagattcttactctttccggcaagtgcctgactgttcctcgggtcaagctgaagcgctgcttcatacgcaccatcagcctcctgtatctgcccaagtccggaaagactgttcccttttcctacccatcctgaagcaaacaggggagacatggagcaggctatctcgaatacgcccagagcttctttgtatctggcaaggttattcagagcagttcccttcccaatccaggctgatgaatccatccggtttaatgcgatggcctgttcatatgcagcaagtgcctcatcgtaccgcttttccagcatgaggacatcgccgatattcttccagaccgatgagtcagtcttgttgagctttagagccatctgaaatgcccggacagcattatcatactctcgcagtttcgtatacacctgtccaagagaggtccaggctttcaggtcggttgcgtcaaggctgagagcagcctcataggcatcaattgcatcgtcgtaccgctcaagatctgcaagagccattcctttgttcgtatatgcaatggcatctttcgggttataggcaagggccatctcataacttttcagggcatcctcaaggtttccaagattatactgggcatttcccttgttgtaccaggccttactgtccttactgtccttttgtaaagcgatctcataggcggacaccgcttctttaaaattttcctggttgtaatgagcattcccctttgcaaaccaggtctcctcattatccgggtctatctggatagcagcatcatatgccctgatggcatcttcgtactgcttctggtcagacagaacatttccctttgccatccaggcctgtacatcataggggtcaagctgaattgccacatcatatgccgcatatgcctcattgagcaggttcttacttaagagggcatttcccttattgtaccagtaatcagagttccggggatcaagcccgatggcgacctcatatgaggcgattgcttcatccacctgacctagtttataaagtgaaacccctttattgtaccatgccgctgcattcgaaggatcctgttcaatagcacgctcaaaataggagatagcttcctggtacattccctggctgtataagacattcccgtctgatatcaggtcatcagactgtgtggcaagagctggcacggtaaaaagcaataccaccagtatgatgaaaccatgaacctgacgtggaatggtcatatgcgaagttactcctgttgttcctaaatagtttcgagcagggccttatgaggttcgtgcttcagcccgccgtatccgcacaagcgggctgcttttctggaggaactcactgataaatggttcaaacccgggttgccagcactcaagccctgaatggacaacaaactcctctttcatggaatgcttgacatgcttgccaagagcagttccaaatacttcatttgaggagaggagatcggaggcctgccggtagcgccggggaagttccaccccgtaccggccgtcacgaatgaatggcccggcaaagatgatatctgaatgaatatacttgtcaatgaactttgccgcattgacatgggcggtgaccggtggacctgcatggaacctgaccgccggaagagtgtcaacaaggagctcaaagaggagcatacttcgatcctcaagcatccacgtatctgcccgtataaccacaaactcatgcctttttaaaagatcaaccaacgtatgcagacttttccgaagttgtgggacgacaatatcttcaatatagggcggggttttcagggtgatcgcaagaaatgcagactcacgacctttcaagagggcgctgacctcttcctcggtcaggatacagatcggtgggcggtaaaaaaaccactttgacggtgatttcagatacccctggcagagctcaataaactcaagaagttttgtatctgacacggaggccgatacattccggcagggatcaaccggatcgatgacaaccagtggttcatcaaaccatttggctgcatgctgctcaatatcgatgaacattccgggtttccagcctgctgcggccttgagcaggttatgaaacccgccatgatgtaggaccaggagttcacacaggtatccggcaaacccctccgtcatctgatcagacccatagactccgcctgccttgacaaactgctttaaaaggagaacgtcatcggtaaaatcaccgatacgtgaagagatataccggttatgaaatggtgtccgatcaactgcactctggatatcggtcgcctcctttacctgataacaggggacaagatcgacatcaaaaccatctatcgtcgcattcaggtacgggtgttcggcgtacttctccctgattatatcggtatattggtgtgcaatgctccatgcaagggcaaggccctcccgttccaggtcttcacgtggcagggcaggatcaaagagcataaatacatcaaggtcccggtcaccatgcacacaggtctttctggcaaccgatccgaccatcataccgtcagccttgccggatccacggatatctgcaataagccggtctgcaagggcgtacatccgatcaagttcttctttggtgggacgtatctctgcgagaactgactgttcaagtggtgaaaatgtcatgaacgctcccggagagagacatggagaatatcagtatatatgggtccgtcaggggtgagttcactctttttcaatataaactccctgaccggaatggttcccgagcatgaggatgctacgcctgccagggcttcaaagagtgactgatgaaattgccttacccgtgcgatggtgatatggggtctgaacttccgcttctccggttcaaatccgagtgaggccagggaagagtctattgattctgcaagtgcccggcattgtccagggtcatccacttctgcccagaccacccggggagcccgctgactattcgtcccgataagccccacctccatggagaaaggtgaagcctctatggtttgtaatatttcagtaatctgcgagagggctgacccgctcacttcaccgataaactttaacgtgatatgcatcgactcctgatccaccagagtcagacgtgcacggcttgaccgcaggccatcctgaacatccctgaactgttccctgatttcatcaggaaggtcgattgcaacgaataaacggaccattctgccctgttatgtctttaccttataagataagggattttggatcattcatgtatataaagagatatatggaaatggtttctgcccggatctttatttctatgaagtaatccaaatgattattgatcattatgggggcggtctttatcgtatatacacttgagttttgtccacgttgtgaaattctcaaggattttcttacatctcaccagatacctttcaccgttgccgacatgtcatctgcgaaggcactgactgagctccgcgtgaacggcatctttgtacaggaggccccggtccttcaggttgataagacgttcctgacctctcaggaactcttcagtggtgacgccatcaatgaacagcggatattgcaactctgttaggtgatggagtggcagggagaacacgtcagactacattagacggtattgccatcccgtcgatgccgcctgtcagaaccagtgacgggcatatcctggaatgggaccgggaccgtattgtcagacagattctgaaagagaccaggcttgtcgagattttttacggatttgacggggcagatgaggagacggcacaggagatagcacgggaggtggaggaccggatcagaaaacttaacctgcgcacgctttcaggtcctttaatccgggagattatgaatatcatccttatcgaacgaggaaggatccagtggagaaatgtctgcaccagggttggaactccggtctttgatgctcaccagatagatgtcggcaggggatttgaggcaaaggataatgcaaacctgcaggagaatgctgaaacgtctcataaaaaaaaggcagacaagatcagcaaggagcaatacctcctccagcttcctccccatctcgcagaccgtcacctctgcggggacattcatatccatgatctcgagtacttcgggacacggccgttctgccaggactgggatctccggtacttcttctactatggtctcatgcctgacgggaacgggacaaaggcatcggtggctggacctgcaaaccgggcagaggttgcagtactccatgcagtaaaggctcttggaagtgcccagaccaattttgccggcgggcaggggtactataatttcctcacattcctggcgccgtatttcacgggcatggaatatattgagatgaagcagctgatgcagatgtttgtctacgagatgacccagatgatggttgcccgaggcggccagctggtcttctcatcagtccagctctcaccgggagtcccaaagctctggaaagacaagccctgtgtttataaaggaaagatctggaatggaaccgatgcacccttgcagacctatggctcctgtgaacgggaggtcagactgctctttaaggctcttatggaggtcatgcttgaaggtgattactggggcaagccatttaattttccaaaaccggagatcagtatagagcctgacttcatgcatgaggacgaggaattcaatgcaaaaaaccctgatcttccgagttatgaagatctctaccttatgacctttgaactggcatcaaagtttggaacaccatactatgacaaccagctcccggcataccggggggcaggggaaggaatctcctgttaccagtgttgtgcataccagttctccaccatggccgataaggatgcagactttgataaaaagctctattttgaagatggcatgcacttctccatgggatcgtggggtgttgtctcactcaactgtccccgggcatcctacaaggcacatggtgatgaggaacgactctttgccgagctccggtcgatgatggacaccgctgttgaggtctttaagataaaactccggtggatggagcatatcaagaagagtaaccggatgccttttgccatgcagcgaccccgtgacccaaagaccggtgaacgtggtgcaatggccgttgactttgacggacttgtctataccatagggattgtcggtctgaatgaaatggtccagcactttacgggccatcagctccatgaatcagatgaggctttccgtctcggagtccttgcaatgaccgagatggaactctacagccaggagctgaccagaaagcacgggatgaccatcgcccttgcacgtaccccggcagagacaaccggtcagcgatttgccgttgccgatcttctccgcagggagtttcacgaggaggcaaaaaaggtcatcaagggtaatctggaagttgccttatcccgtcttggcgatacccgcgatcttccgatatactatactaatggaacccatgtcgctcctggtgcagacatcacccttgcacgccgtgccgagatcgaacatgtcttcttcccgattgtggacggtggaaatatctttcatatctggcttggtgaagcccggcctgatccccgtggcctgatggacatggctatgaaactctgtcgaagcacccagataggatactttgcattcacccgtgacctgaccgtatgcctgcaccagttctcggagtgggacggcaaacgggctcatatcccggtaaaagatcctggagagactcaaacaggaatccagtcgccaattcacgtataaataactcttttcaatttttccccataatcccccctcataattttatcaacttgcaaaacccgcatacagaaatggatgaacaaagtgacgataccaaacgctaggtcagcatatgggtctggtccagtctgaagatcagttcaaagaatttatcgaagatcttgatacttgacaggctgaagccaaacatcttcccgagcgggctgattgtaaaactattgatgttccggtcatatacccggtaaggataggtttcgagaagaaatcggatacaaacccaagcctgaaccggccggccaccagatagatgaaactgataaagagtgcatgagcaccggcaagtgctgcatatcgtgcagaatctaacatggcaagaggggcgacggttgttgcaagcaggatagccgtggtcgattcagttccattgatgatctgatgagaactgctgaagagggtatatgcaagcatggcaacaaatccggctaactccccccaacgcaaggtttgaaggaagaagaacggcaaataccactgcccctgcgatacgatcacttctgaatcattcacgccggtaagcagagagatatgccagccagggagtataatgcaacagccggtcaatatgagaagacccatccttctttccttcgaattcgctgccagacatgctgtgtatatctcctgatgtatacccgatcgatagccccgatactatttgaagagaaggcatctgttattttatatttcagagtaaggatcaggtatgacagtactatccgtgcgttcttttttctgtgcaggtctcatccttcttctgcttttcacctgtggaatcagtgcaaaaaccataccgccgactgacactttggatggctttgatgaatttatcacccagaagatggctgattttgatgtgcctggtgtcgtggtgggcattgttgaaaatgacactgtcgtatacctgaaaggattcggggtccgtgaacttggaaacccagaaaaggttgatcctgatacccggtttcagatagcatcagtcacgaaatatttcaccggtggagccatcggaactctggtagatgaaggaaaactggattgggatacaccggttgcagagtatcttcccggtttcaccttaaaggatccgtatgtcggcaatcattcaaaccttcgtgatctcctggcccaccggaccggacttcgccgcgatggtgaactactcggaagaatcggaatttccaatgatgagatattgtaccggatgcggttccttgagtcagatgcagggttcagggagcggtacatctactcaaatgccgggtatttcatcgccggggaggtagcagcacaggcatatggaaagagctgggagaaccttaccgatgaacgactgatagtgccactcgggatgacccgttcaggggccagacatgaaaccctgtaccttgatgataatcatattaccggccatgccagtactcctgatggaacattggatataattcccttcgaagaggcgtcgcttcccgctgccggccagattgtttctaccggccgtgatatgactcagtggatcaggttgatgctgaataatggcacgattgagggaacgatggtactcagtccgaaaacggtagaggatattcatgcagcaagcttcgtcgccggtccttcaggtccccttcatgatccaaacggggcagtgggtcttggctgtgactcctattacttccttgatgaacgggtcattgagaagaacggagcacttgatggtgtccgctcaattgttgttctcattccggggaagaagagcgggattgtggttatcgcaaacaagcagctgacggcatttcctgaagcagtcagggatgagtttcttgaacggtatatcggcaggagtggaatagacctccaagctcttgaactacagaatcaaaaggggtggaactctttaattaaaaatcctgatagacctgaaaacccgggtcctgcgactatcagccctggtgcaatcgaaggggtgtatgcgagtcccctgtatggttccattcagattgacctgggcccagatgcggaacatatgataatcgggctcgggcaaaaccgataccaggggaacctggtccactggacagataacacctggtatctctcattcccgaacccggatgatctggtcggatatctgacgttcattgcagatgaatcaggaacagtgacaggtattgaatccaatgagttcggaccgttcactcgtgcctgaatcaggaattcaaatattcctttttcaggttccggatgaacagcccgatgacttttagatgaatttattgctatccgataatgtataattcagataatgggcattctcattatcataggcattcttattctggtgatcattatccttttcgttggatggcggtatgcttcacagcgacgatcacttccctgtccggtatggatgaaatggatgctggatccgccgtttgcgtggatgagcggccggacaagaaagacgattgaataccttgatgtcaacccgggtatgcaggttcttgatgcagggtgcggtcctgggagagtatcaattccggttgcgaagatcgtcggacagacagggaatgttaccgcaatggatattcaggaagggatgcttgcagaggtaagaaagcgggcagaaaaagagggtctttcgaatatcagatatctgcagggtggtatcggagaaggaaaactcggaaaggagcagtacgaccggatcgtgatgattaccgttcttggtgagattccggatcatgaaagagcgatgcaggagatctatggagcattgaaacccggtggaatgctgctcatcgaagagacgatccgggatccacatttccagagagtgcagacagtaagagacctcgccggtgggatcgggtttgttgagaagggatggcacgggagcaggtttaattattgtattctgcttgggaaagagtaaaaaattgaaatttccatctgggattcagagtattcaatattcatttccctgtatgcggtgatgtggatagtaaccgcgtaaattttaattcttatcgattgtaggaatattcattttccagtatttctggttggggtacttctacatatcatttcccggacaagaacgaaataatggtgtgtcgaaattaaatcgcacacatcgatcctgagtggacctgtgcctgtttgggactggttcaaaagaatcttgcaaaaaatcttgttgatcgatacgttgattgttggaaataggatttgtactgttcacggagagatccccgtgatcttgacaacatttgattcatattctctgctgacttatagtatacgaaaccgggtgaatacaatatggatcggcgtatcccctacgggataataaattatgcagagatcatagagaagaagggatactttgtcgataaaacccattttatcaataaacttgagaacattcagaatcctgtatttctccgccccagaaggtttggaaaatctctcttctgttcaatgctacagcactactatgaccttcggaataaggaaaattttgaggaactctttggccatacatggataggacagcaccctaccggagatcagaataaatatatcgttcttctctttgacttttctgaagtacaggttgaagatggtcttacgggaacagaacgtaattttactgagtattgtaacaaccttctcaacaacatgcgactcttataccctgaatatctcggaggttttcccccattacatgttcacaccccggttgcaacgaatcttaacaattggctcacgtatctctggatgtcaggtgccccccctgtatacatcatcattgacgaatatgataactttgtcaaccaacttatcacaacttatcaggatcgcctgtatcaggaaataacgaccggagacagttttctcagatctgtgtataaggttttgaaagcaggaaggcgatccgggtcagtgaaaaatattttcatcaccggtgtgcttccgattaccatcgatgacctcagttctgcgtacaacatctcaacattcctcacgcttgatcccacctttgagtctatgctcgggtttacccagagtgaagttgatacgctgatggatacactctaccatgattataaccttgatccctcagttcgtctccaggtggatgaagtagtaaaaaatatgtataatgggtatcattttgtaagtccccatactgcagcagtatataacctactatgctcatgttcttcctcaggcagttttgtgaacaaaagacaatcccggatgatctctttgatctgaatctgcgaaccgatctctcgtggattagaagactcactggcgggagtaatgagaataccaaagaactggtcagccagctgactacccgtgaaaccatctcaattaaccgaaaatcccttgtttcacaatttaatgtaagtgaattttttgaacctgttttttatccggtatctctgttttacttaggcatcctgacgaggaaggatgaatttgaactcagcttccccaacctttcgatgaaagagatagcagttgagtactttaatgaaatatttcgtattgacctcggtcaggaaaaatacaaagagatgatgcagggatttgtggaaaaccctgatctatttaaacttttttcagattactggcagttatatgtcagccagctccctgaatcagtctttgcccagatgaatgagaacttttaccgcactaccttctacgaactttgcagcaggtatctttctccctggttcacctggaatgtggaacgatcgtacccttcaggtaagagtgaccttgagtttgtcggaaagtatcatgaaaggttttcttctttgcgatgggttatcgagtttaagtatttttcaaacatcgaattggccaggctaaaaacgccgatcgaagaatttgaggtacaagaagaggataccaggcagataagagggtacgcagaggggctgattcaggagtatccggaggcaaagatacgcctgtttgttatatattgttttgggaatcaaggattccgagtgtttgaattaacaaggaatagtcctgggaaattttcgtgaacttctcttttatatgaatcgtggactccttatatcaaaataataactagatagatctaacagaaaattttcgacggatttgcgataatggttctgatatgtagctttaggagaagaaggagaataatacgtgccgaacctgtggggatgagaataatccatattcgcggaattactatgggtgtagaggaaaaaccaacatagaatcggactctaattattggttttcaagactttctctaaaccataaaaacaatactccttattaactgaatttcttgaattttatcgaatatccaactcattagttctgtaatatttttcaatacatccggttaatcaatgaccatctcatgagttatatcgcttcactgaagtatccacatgtaaacccatgataaccaacgaaccctatgaaaaattctattctcgtgaaaaggacagataccaatgaaaaataatattcaatctcatacccctgaaccaatatccggaacggaatcatcaactcaagataagttaaatccctccctggatgtcattctctcaaagttcaggcctatagatatttctgatatctctcatgcaaccctgcagaaccggaaagaatcaaaatatctgctcaccacacatcaggctctcgatcttctcaaacaccttccggaaacatatcacatcttcgaagtggatggaaaacaagttcagacctacaaaacgacctactttgactctccggagtttcaactataccttgcccatcataacgggcgaaaacctcgatacaaagtaagaacccggtcctatatagattctgacctcacgtatctggaggtaaaggagaagaaaaataccggacgtactatcaaacaccggcttcagatcgaggagctggtcaccaggcttggatcagatatccgtgaatttctctcgtcatgtttcccctttgactatgcagagtataaaccagtgttgataaacgaatacagaagaattaccctcgtatctacaattcatcctgaacggatcactcttgatatcgatctgacctttcattcaggttccatcgatattctgctcccaaacattgtcatcgcagagataaagcgaagttcagatcatattaggtcacctgcccttgactatctgaatacgataagattacgaccacgagggttttcgaaatactgcattggaatatcacttttatatggtgattttgtgaaacataacaacttccggataattctgcggatactgaataaactttccaatggaggaccggtactatgttaaccgatccctatggttcattccttgcgggaattctcataaatcttcttgcagcggtaatcatcgcacgaggaatctattatccgagaaaaagagcccaggattatatatttacattcctagcattctcgaccgtcatatacctggtgatgggtctttttacatcagtcgaactcacaatcggagtgggatttggcctctttgccttgttttctgttctcaggtaccggaccgataccgtgcccatccgggagatgacctatctctttgtcatggttgctctgccgatcatgaactcaatcctgtataatagcggggatattgtgaaattatgcctctctgacttcgtgatcattgcggtgctcttcattcttgaacagaaatggggattcagatatgaacagaagaaactgatcaagtatgagaagatagacctgattcgtgccgatgaacatgatcggttaatcgaagatctgataaatcgaaccggacttgcaattacgcaggttgaaattgttgaaatcgatttcatccgggattcagcggacatcataattacctatgaagaagaggctccggtcattcataaaaaaaatccgaattctgataacagaccggttgaggaatcccttcctcttcatctctctcccggaaccatagaataaatttcggatagggaatgttgaatttgctttattcccgcgatattactgatagaacattgaattattcattagctattcaactctttttcatgttgcaggagtattctcttctttaattccaaaaactcctcttctgaaatgaccccatcggttttcaattcatgtatttttatcagttcatctgtaaccgaagggattcttttactttcctcatgttcactccgtatcctcatctcatcaagaaaaccggatgcaataatacccgttggaagggcaataattccaattccaagtaacatcatcacgatagtaaacatttttccgatatgagtgacggggtacacatctccatatccgaccgttgtcatggtgacgaccgcccaccagagagcattatcaaaatcctcaaacttttctggttgtgcttcagattcaacggtgtacatgacaaaggtggaggagatgagaaaggtgaagagaataaggatgatagagaagatataatccttttttgtaactactcaactttaggaagttgaacaattgccattctcgacaggtgcttcaaatcctaactttcttcccaccaattgcatgaaattctccttttgtttcttcgaagtttcgtaaatactaagcaagactccaaaaccttcagctccgagccatgttcttctccccccactaatttttcgatgaagtaccccctgacgtatggcacgttccgcatcattattatgccatggaacatcctcatggaccatgaaagtaagtaacatatcttgccgttttcgaagttctttggaaatacgaataacatctggatctacccattttcgttcaagcaagcccgtaagctcagcctgaaatttatcacgtgcatttttccgttcatccaaagatggtggaggatcattttcagtatattctaccgctttttttagaatcgaacgaactccatcaacaaactcaagaaatttttctggaggtctgccttttcttagtattttgactggttgagaggtcaataaacttcgcggttcaattttgtgctttatttctgctctttccaaccatcgattcacatgaagaagatctaactgatgccctgaacacattatgacatcatatggtttccatgcatctcttcctaaaacgccattaaaaccttttaaaacttcttcgggaaccgaatgtcctcgagttgatgccactttgtaatatgagccaattgtcgaagtgaatacccacaaccatccattttctccattcactctgaaactggtttcatctgcattgatattgttctcctgaattatcttttctttgagtttttcgtaatcttctttgagagtatctgcaacccacctttccagtttcagaatggtagcttcactcatttgaatatcgtatgtttctaagaggctggattggattttccttatagtcaatcctaacattctatgataagcaatccaagaggctacagcaggtccgaattgctggtttggcggtaagggcaactctccacgtactaatttcttgcaagttgaacaccaatacctcggataatggatttcgtaaacgatgtgccttggaaatggaatatccgtaatggtgcgtgtttgttccgccccgttgactggttcattcaaatgcgttccacattcaggacatgaatccaaggggatattcatcgatggtgaattggaagcgggtcttttccttccatttccttcatgccctggttgacctccacttttcctattttcttcacactgcctcttccggcgataaaaggtctttgaactcggaactcctcctgcttcagctgttttacttgatgctgagagaaaaggtgcagaactcaatatttttgcaatttcttttttgagttttttattttcctttttcagttcatttttttggttttctgctaaaattctgcgtttacgttcaattttaagttctttctttaattgatggatattacgccgtaaatcgtctatagattcatcactgatttcggaagtcctattattcgtcattatccagaataaccaaataaaccgttttacccaaatgttccttgggacaatctactttcgcacttgttccaaagggtttgacttctcgtttataaaaaccacaaatgttgtttaccttcagttctgtagcaacattgaatggaacagttctcattagatatctattagatatctatagtatttaatacttactcatgtaagacagctttggagatagatccagatccggcgacataatttttcaactttccgtaatatcaaatatgtctcatacataaacctcgagatacctctcccactttattctactactcgtacgcgctaatgtgtcactatagcggtctaaactaaaaacattgaagcttcgtataggcactagagaaaaaaggaagaattacgagtttttcctgattttttaccgatagccagtagtacctaaccctccatcgggtcatttatccgaagataagaccctattgaatttctgaaaatttcaaggtgagagtttcgttattgttgcggcttttgccaaggtgccgcagtgatctttctaatttatcccatcgtttcttaacattgcctgtgccaaataaattttgattcaatatgctcaaaaactccaatcctttctctgaaaatacttttgaccatagcatctgagtatattttcctttatcattttttcgagtcgtagatacaatccaggtaaacagatctctgctaataataaaccgtagcaacatggaataaatgtgaataaacgccattggttcattattgagtaacatttttccaaggtcgtaatcccctttcaattccttgaaaataagttcaatcacccagcgaaatcggtataactcataaatatcatcagcagaaaaaacctcttttccgagatttgtgatgtagagatgccatttttcagtgagaggattccaagaacaaattaccctgaattcttgaaatattggagttttaattttgttaatatgcttgtctccaatatgaaatgaacagatgagatcataaacacctttctttggcattctatctaaaaaatcatcaccatttatgcttttaaagcaattatgatctacaattgatgttatttctggagggcctgaattgattgaaacaaccttaaaaacggcattgctttttactctactagcaaaaaaacctccatattcttgaattttagagaatgttttcagagaatagtatcccagatcgttaatcaggagaatattttcaacatcaggtccaatttttagcatcttatagtcatgaactctttctgttgtaattattgcattttttacagaatggtaaacaacactgtaaactgcatggatctttaatcctgcagaatcgtcacgggaacgtgctgcgggatgcaaatcgtagagctttttactaattcgaataatgctgctgtcttgaactaaaatatctttgaaatcctcaacaattccctttaaatgagcaggggactgatgaactatttgatcgatataatgatccatcagggatttcaaaaaatctactaatttataattaaaccgtttcctgaaactttggttaagaattgaggtttcaatctttggattatcatcaagatcaacataatgacgatgaatctcctctaatgtgggttttagatgactgctgactccaaaaatgagggaaaatatcaaaaggacaggatcgagtttccgttttctctgcataaatcctgtttcccgagcttttttttctataaaatcaaaggtaaatttctgaaatacccaagattttaggtttttttgacccttagaagaaggcttcttcatattctttaggtcgcccgacggtgctcaccgtagggcggcgccgaaaatatataaatgtatcgatttaaggttggaattgtattcttgctcagtaacactgatttttgcttagttaggtatcaggccataaagctgtcttacatgaatacttactaaattcccttgattttttatcagaaaaaagatgacaaacaaatatattatgggggaataatcctatagaagtagatttctctatttttgattactttctaaaacctgaattgttacccttttttttcacgaggacggagaaaatgacatcaacagtactgtaataacgcaggagtttaaatatcctgaagattctgcatagtctacagaactgaacgacccttggatgaaatgggaaaaagagtgctacgtaaaagggaagaattgcgataaggtcgataatcatgtaaatagtacatgcatatttgagccttcccttcaccggatcacgatagtccttgaaacaggtacatgtccagattctcaaaatatattcaatggtaaagaccagaaccgtaataatctcaatgaaagtagcgatttcccggaattcttcatagatagatttgtatgattccaggaagatgagggctacattaactaaaacaagtataattatgaagaaatcaaaaaaccggtcaggtttggattcatgatcagtatcatcgataatattgaagattttccacttcagtgaagattcagaatccaatcttatcagaattaatgtctttttttaagaagaaaatggtgtcgatgattatcttctttgaaagagtgagtataagcaaaaaaagaagaggattatgtatcagattgggattctacatactctattgctttttcgtattgggatctgatatgggctttcatctcttcaaaagcagcatcaaaatctgattcattcgtaagataagtatatccttcacgctcaccatccggtccgatgacagatgatgcaatgatatcatgatactgatcacagatctcttccatcttttctggatcaaaactcgtttctgcaactcttttcagaatttgaacatacagtgcatggtactcttgatcatccatgagatacctgatgagcggccatctttcagttacattctccattgaaaacgatacactgctacccattcccatacccgggccgaattgaccgtccattccggacatggtcatattcataccacccggtggcatgaaaccaggctggttcggattattcattccatccggtccccactcatgtccgggtcctttcatttcaggaaaggtcatgttcatcccttcaggtggtgcaaacccaaaacccggtgttttattcatctcggcagaaccaccatctccaaaatttttccccattccttccatgaatgcataattgttatcccaggggatccagctgaatgtcccggtatccggattattatacaggtaataattccgtgcatttcctccatacgtgtcccaatttttgatgagcgtattggttgccagccaggtgagaaactcagtgacgttaaggattgattcaaggtctgatcgccaattttcgggattttcggttcgtgtctctgaatgaagaatagtgtagagttgttcgatgtcagaatagtctccttcatcttcattggttttcttctcgaagtgagagagattgagttttccgaaagcaaaggttgcaccttcttcctccggtttatagagatttcccgttccgtttgagaactgagttttaataaccgtatcatcgatgctttcaacgagggtatagaggccgaaatattcaaatccgtctcctttatcgatgaataccttataaaaagcagtctccggagcgatcacccctgcatcctgaaagatttcaggggctaatttttcccgtatgacagacacatcagacattccggattgtagattgagttctttaaacccgaaaaaattctgattctttgtctcagggaactcatcctcgtagtgatccatatcaacttttaaggagatcttcccgattccctcgctccatgcagtcatcagggagtttactcctttatacctgataccgacatgatcccaggtttcgttctgaaatgagatggtggcgggaacatataccggatcttcctgattcagaaaaccagggccgttttcaccaggtggttttggcatattcattcctgctgatctgttaacatcaggcatgttttcacccggaccacccctttttccgggtccgggcatactcccacctccaaactccccgtacttggccgtcatgtcttcctgcatttcggtccaggattcaggactgatggtgatattaatttcacggatttcatcatccggaaagaccgtatcatagtcgggagccgaatctgatgcaaggaggtgtaaactctcatttacatcagcacttcctggctgaaggagaaggagacagattgcaaccaggataagtgcaaaaatctttgtcgaaaagctaatttgtgtcatgatagtcatatgaaattgtgtattccgtccggaatgggatggggcttgagagtattatctgacagccatggctgcctgaagacagatatctcgtactgagtgaaatattaaaaaagcggattcagatggttgaaagatacaacagatcagtatgacattactaaaaccaggtacgtatccaggtgaagaataggaggcagatgtaattttcaatgaaatgttattctttcacagaactgaatcgcctggtgaacaatagtatttgatcctaacagcccatttttttaaaatcccattcagaaattgacaaaataataaatgaagggaataaaaagagatgatagtaaagatacattgtcactatgtggaccgtgacatcgacattaattctctttaatttgcttttaagggaagaatggtattcttctctcatgtttcctcttgcctggctccactgggatggatgcacaggcaataaatatttatccagaatacgtattgttagattgtcaaatccggaagcccggaagagacttaggggatagtatttatttcgaatccgtttccttattgcatgtggagcactgggatatttgctccatatgtatgttacttttcatcgaaattcactgttacaatgcacgtgtttgaattcacgactcacaaagaataaggcatctcttaaaaaacaacgaatactatgatgatccgttgtttccaaggaagaagattccaacaatgaataaggtaatggtacccaaggaagtatcattagagcaatttttagaaataattgcaaaggcggatatccttattaaagcaccagatcctgatatttataatttatcaaaggctgtttcatgaatgttttttattagcactatgagacaaattcaggatgggtatttttaatttcacaacgttaatttcctttattgtactatcaagattgatttatgcaacagctactattgttcaaaaaaagtaatacctaataacttaggcatttgactttggtatctatgcctcagcccggatttgaaccggggacaaccagatcttcagtctggcgctctcccagtctgagctactgaggcgcgactatacagattacactcatgcataattaatacttttcatttgaacctcatattcacacacaattaccgggaaccagtacggtatataccacgtccattaaggcatctgaataccgacattatcctgatgtttttcaagagacggagtgcgaaaccggatactacaaaaattcaggcagatatcgctctccggacagttaaagtagttcatcttacccataacgattttgacgctgttggcgctgatgcagttcatcgaattagattcaggaaagaaggagtgtacacggtattcagctccgttggaaaattcccgatgtacctggatatcatctcccaaatagcaggcaaaggagacaccctctctatcagcgacctttcataccggaaagggatcgagcaacatcttcgaagactaaaacagaaaggatggcgaatagaatggcgggatcatcaccggtggcacgaagatgagatcggcttggtgaagagcatcgttgatcacctccatattgataccggccgatgtgcctgtggtatatgtgccagcgacctgacaccggatgatgtgatcgcccaggagatcgctcttgtggtctgtgattatgacctctggaagcaccaggatccccgttccggtgttctgggccttgtacttcagcggcatgagaacagggagcatgtccgtgatatgatcatgcttggggtctttgatgacaagaagatcaggagcgaatatgaggatatcatgcgggagatgaaccgggtcatggaacggaccaagcgtgcagcaagtattcttggaaccaaataccgcaccgttgtcgcccccatgtacggttacccaagtgaaaccgctgcctaccttcgaaaagaacttggatctgatatcgaggttctggtctcccagtcaggaaaattttctatcaggtcagttcccaatatttcccataaaattgccagggagtttggcggcggtggtcatcccaatgcagcagggggattcttcaattttaccctgacagataaaatactcctccgtctctttaaaaaaaaccaatggtttgaaaaaattgccaggtacgcagacactattcaaaaataactgcagactccttaactttttcccagtactcttcttctgatcctgctccatatcctgccaccttcagatgatcatggtccacgtattgcagggcatcaagaagggcgggttctgaagcatcacacacgatgagatttctcacctggtaccgatccataagatcaccaacatgggagatcatctctgcccggatgataaggtctgatgtgtgctctaagagttcctcaagagtatgaagggcagggtgctccatgaaaaggagattttttggaccggacaggagttccagatcaaacgggccggaattctccagatgtatgatatgaccggagacacggttatcccgcagagttctcaggagctgacgaaatccatggaacatctcagcataggcatcctcgtcatcaggggaggggcaggtagacaaaaccgcaggactctcgtgcaccgaacgtatttgcctgcctgaactggttatgagttcataatcggcgaccatggcgtcaggaatgacatgcggtccggactcttcatcccaggacagggcctcttccagccgtgacctgcaaaactttccaccgactgctatctcatctatcttcgcatctttttgcgcagaaaaggatcggagtaattgaaaggtgatgagatcagcttctatgccacggtatgcggagatgaactcctgcaggagagaaacctggggaatgtccggatctgaaccgagtgacaatgttttaaacgctctttttttcttcataaaattaccatttaccccagaggagcttcctgcgcaactgtcagtcagtctgacatgccggttcaggatcagggagaacagaggtcctcatcctctgtatattttatagaattatcttcaaaaatgtacctgatgaatagccgcccacttcttgttacctgtggccttccctataccaacggcccctgccatctcggccatctccggacatatgtacctgcggatttttacgtgcggttcatgcggcgaaaaggagaagaggtggtctttatctgcggctcggataatcatggaacgccaatcgtcgtgagtgccgaaaaggaaggtacaactccccgccagatatctgaacggtatcatacccatttctctgacaccttcaccaagatgcaggtgcactttgatcacttcgggatgaccgatgatccaaccacccatgcacggacaaaacatcttgtcagccggctgatagacaggggttatgtatacccgaaggtcatccagcaggcatactgcatacactgtcagaagttcctgcccgaccgataccttgagggaatctgtccccactgcaaaaaaccggcacggggagatgaatgtgatcagggatgtgggaaacaccttgaaccgggagaaatcctggaaccgacgtgtaaaatctgtggcaaccgggcagaataccgggagcaggaacatttcttctttaaactcagcggattccaggactggctcagggaatatctgggcgaattaaaagggaccgataacgccatcaattacgccctgggctgggtgaatgaggatctgcatgactggtgcattacccggacacttgaatggggagtgaaattcccaggtcatgatgatctggtcgtctatgtatgggttgatgcccccattggatatatcggatttaccgaggagtgggcagagaagaccgggagagactggaagacgtactggtgtggtgaaaacacacgggtgacccattttatcggacaggacattacctatcaccattgtgtcttctggccggccatgctccatggtgcagggtatggaacaccctatgcagtagttgcctcaggaatgctcaagattgatgaccataagttctctaagtcacgaggatatgtggtctggaccaatgaggattatcttgaccaggggctgcctgccgactaccttcggtactatcttctctcctacaccagccatacaaaggagatgaacttctcctggcagctcttccaggaacggattaataatgaggttgtcaacaatctgggtaacttcatataccgctcgcttcatctctcccagaaacagttcggcggagtgcctgaaggtgtggtagagcaggagatctttgaccggataaccgaggccatcggacaggtaaccgggcttgttgaggcctatgactttaaaggagcggttgatgcaatcctcgcactctccgcctgggggaacacatatattcagagtaaagaaccctggaaactggcaaagactgatcaggcagccatggcacaggtcatgaggaactgtcttcagctggcaaaagccctgacgctcctcattgaaccggttatgccggaacgggccggactcatctggagccagctcggccaggacagcctaatagccaataatggattttcagccgggcttgaacctctcagccccggaccacttcctgcaccttccattgtattctcaaaaattgatgataagatgactcaagaactcgataaacgactccgtgaccggatagatgctctggatgcggaaaaaaagcccaagaccccggagatctctattgaagagtttgcgaaagttgagatgaagacaggaaaaatcctctctgctgaacaggttccaaaatcgacaaaacttctgaaactacaggtcagcatcggcgatgaagtacggcagattgtgagtgggatagcccagtttcacaatcctgaagaactagtcggaaaagacgtggtcgtctgcaccaatctgaagccggcgaagatattcggaattgaaagtaatggaatgatcctggccgccggagataatgcatcccttttaaggcctgaaaccccggttccatccggaacaaaaatcagataattaaaaaaatctcttttttctgtcacgacattatctgcgatagtgcagtccgtattgcattcttcacatcaggatcaggttcttgttccagtgcctgcataagaggagtctttgctaaatcagaaccagacctggcaagcccctctgctgcaatcctccgggtatacggatgatcatcggtcaggagcccgatgaggatcggaggaattcgtggatcctgcatctttccaagagattttgcggccatgtaccggacatgatccttttcatcggtggtaagagcgataagggactcaacaacctggacatcaccaatcgctcccagtgcttcagcggccctgtacctgattacccagttagtatcattgagtaatgtaagtaagggtgggactgcggtttttcccattccggagagggatgctgaagcatgtgcacgaacttccttatttgtactgcgaagatctgccaaggcagactccagttcaagtgaagacatgaaaaaagaattggatgttatcaaagaaaagaatgaaggattaggtatttcctcccatccaaggctgccccacctacctaatcgttctctcttctattgttatgtgaccggtgctacggtcggctgtgccattgcagttgatgagtattcatgtgtctgagccagatcaaacagtccgcgagccacagttctctgccggtctgtaatctttgtcgtaacatttccatcgccacttgcctggtaaatgttatcataggtctcaaagttggtattcatatagacctctgctgccccgaccgccagggtattattcgcattggtacccagaccctgggcatcaaatccataccgcagattcaccgggacggtagaactctctgaaatcgcacggccaccaaccgtcgtcactgcagcaacctcctgcacattcattgcgcttcctgcttcaacagttcctttgaacgctgccccgtttcctccggttccacctgcgaacacacaacgacctacttcatttccattcgttgctgccccgagtgatgtgatggttgctccctcatcccacagcatcgtaccgctctggctctgatcagcctggtaattcaccgtatgtctggcgtagaggttgtctctgccatcagatacattggaaccatccatattgtactctttcgtgtacctcgtagttccactggctgcaagggtattttcacgataggtgaagattgcccttgtttcatctggtgaaagtgtattattcgcgagatccccattgggaagattcgtctgctgccactccatatcatgatttaccagaagtgtaccgatacaggttgcatcgatagtagtcgtaattccggtctgatcatatgttgcagaagtaggtctgacagcagatgcccacccggttgtaagaaccaggattataataagcactgtgcttagttgcctcattgtacaggcattcatattaatcaaccccatcaattttctgaccacatccgtagtcagactggtcacgaaaatttcgtcggttatacatatataccttgtcaattttcagtgacagaaaaattggaatttagacgatatccagaaaaataaatataaagaaaatgatttaatcgagtgatgaaaattggggggagatttaggcaaggtaatccgcgggcttaggcagctcttccttgagtcccttgcgctttctgatctgcaggacaatatccttggcagaacctgccggtacaatctcaaaacctgcaaattcgctgttccacattgcacgaccttcagttgctgaacgcacatctccggcaaatccgaagagttccgcgaccggtgcctttccgatgacggtgatggtgtctccttcactggtcatatcaaagacctgaccacgccggctctgaatctgtgaggttgcacttcccatgtgatcctgggggacagtgatatgcagcttctgcatcggctcaagaagtgagtctccagcaaggagcattccacccttgattgcactccggacggcagggatgacctgagccggaccacggtggattgcatcctcgtgaagtttgacatcaacaagcttgataagcatgttctgaaccggctcgtcagcaagcggaccgccatcaagggcttcgtgaataccttcgatgataagctccatcgtttcgttcaggtactgaatacccttggtcatgtcaaggaagagatttgtagcatagatatccttgacgttttttgcctcttccttgtcaaaaccggccttgatcatcgtatcacggcgttcaagagactcctggttcatggatatctcatggttcttgatcatctcaacaacatgctcagggagcggatgaagtgtgaagtagaaccggttgtgacggtttggagacttaccttcgactggttcggtaagttcctgggtgatggtttcacggtacaccacaatcggttcggaagtgatgatctcaacacccttatcacgcttgatacgtccggtgatgatctcaaggtgcagttcccccatacctgaaatgaggtgttctcccgtctcttcattaatattgacacgaagggtcggatcttcctttgcgacctgacgcagaacatcgaccagttttggcagatccttcatgttctttgcttcgacggcaacggtaacgaccggctcagagtaatgctcaagggattcgaacggtgtcatttccatgaggcttgaaacggtagaaccgacgatggcatccttcagaccggtaactgcagcaatgttccctgcatagagctcgggaacttcaacacgggtcggacccatgaaaataccgacctgctgcagacggttaaccttctttgcagttcccatgacatacatttcattgccccggctgagctttcctgaaaaaagacgaccggttgcaacttctcctgcatgaggatcaaaggagatatcagtgaccatcagacagctgggtgcattcggatcacaggtgatcataccctttccttcaggactgttgacatcaccgtgccagataacaccaatacggcgtggctgagcctcttttggattgggaaggaatgatacgaccatatcaaggacgacttcacagagcggactctttttcccaagctccttcatctcacccttcttacagtgctcatatacttccttaaaggagataccggactttttcatgtacgggacagaaatagcccagttgtacagtgctgacccaaatgcaaccgttccattggcggcatcaagtttccagccattgttgtacatctcctcattcatacccttgatcaacttgttgaccttgtcaatgaccttaccaagccggatctgcatttccatctcatcgacctgaagttcattgatcagccgatcgaccttgttgatgaataataccggcttgacacgttctttgagtgcctgacgcagaacggtctcagtctggggcatggttccttcgactgcatcgacaagtacaactgctccgtctaccgcacgcattgcacgggtaacatcaccaccaaaatcaacgtgaccgggggtgtcaatcatgttgatgaggtactctttaccgttgtactcgtggaccattgatacgttggatgcatcaatagtgataccacgtgcctgttcttcctcatccgagtccatccagcaggcttttcctgccaaatcttcactgatgatacctgctccggctaggaggttgtcagaaagagtagtcttcccgtgatcgatatgggcgacaataccgatgtttctgatacactccggctggttcatgagctgcataacgcgctctaccgttttcttccctcggctcatatttcacctgcaatttttaaaaaacagaaatgggattgttatttaccgtgcagacttagcaacacgttcccgttcttcacgctttgcgacagagtaacacttgacatccccatttgcagcagcaatgagttcctctgcgagggcatttgcaacgggtttcttcttcttgtgagatgctgaatagacaccggctgcgattaaaccgactgcggtattaacccggcgcatcggtgcggtatcaacagacttcggcacattgataccaccatacttcagacggacggtctcttcacggggtccggcatttgcgactgcatcacagagtacttcgattgggttctttttggtcttctggtgaacaatctcaaaagcatctctgacaatccggatggcaagctgcttttttcccgtgtttacttcagtacgcatcagctgattgatcagccgctcgacaatgagcatatttgctttatgaaactcctggcgggtaagacgcccacaggaatggggcaccatcatcgagttcaggttcacgtaccgtgcgatacctgggtcacggatggtgacctcacttgtgtcccagcggttaaagaggagacgagccggggcagatacttcttcactcatcacgatcacctgcgtggcttctccttcctgcctatcaccagttcatggagacagacattgttcaccttcgtgacaacaaaccggaccccggggatatcgcccatggaacgtccgagacgaccgccgataccttcaatttcgacttcatcgtgttcatcaatgaagttgatggcaccatcaccgactgcaaatgcagatacctgacgtccgttcttgatcagctgaacacgaacacacttccggatcgcggagtttggctgttttgcttcaacaccgatcttctcaaggacgatacctcttccctggggcgcgccctcaaggggatcggacttcagtttcagaccacctgctgttctcgcaaaatgcgggtcactccagcgaaatctcgcagagtcacgctttaatttacgtgctgcaaatttaccctgtcccattacatcactctgataatcttcgataattccgccaataagtggcgaattagaatccaaatgcgcgacgattccgatataaaatgtcggctttgaaacctgtctgtatacgttgacacttatgcaatataatagttgtattcacgcccaacctaatctcatgcagatcagactctacaaagaggtctcatttgacgcaagtcaccggttgttacattaccgggggaagtgtcacaatcttcacggccaccgttggaaagtggaggtgtggctttcaggttacaccgatgaagagacaaatattctggttgactataatgagatccgtgaggtcgtggactattatgaccatgagatcatcctcaatgaagcagatccgatggtcccgcgtattcaggagtttcatgaggtcattacgactcctggtgatccgacaagtgaacttctggcacgcctgatcagggatgccattgaattgcgatacaaagacagcgggagagatatcatcgtcgataccatcagggtctgggagtcaccaaccggctgcgcagagctcaggcatgaagatcgctgaaatatttacctcactccagggagaaggactgacctccggctatcctactatctttatccgactggccgggtgcaatctttcatgttcctattgcgatacaccggcaagcaggcagggtggaatggatatgaatgtgagcgaagttgttgcaggagcccttttacaaaaaccacactatgtctgtattaccggaggtgaaccactccttcagaaagatgaggttgcagaactagcccgccagcttatcaaagccggaaaaatggtgagcatcgaaacgaacgggacagttccttttgatgatcttccaagtgacatttcgatctgtatggacgtgaaatgcccgtcttcaggtgagttcagtaacatcaacctcttatctgatttgaaatccaccgactcagtcaagtttgtggtcggaacagatgacgatctgcaatacgctgaaaaagtcattatgtcccacccgacaaaggcagagatattcatctcacccatttatgggaccgattatcaacgaattgcatcatatattctttcaagaaatctaccggcacgaatgcagcttcagttacacaaattcataggattaccctgaaatgaaagcagtatgtcttctgtcaggcggaatggactcatccacactcgcctgtcttgcaaagcatgatggatatgatatccttgccctgcacttttcttatgggcagcggaccgaagagaaggaacgggaatgtgcaaaacggattgcccgtcacctcaatgctcttgaattcctcgaggtggatcttacctatctaaaggcagttggagcctcaagtctgacggattatgcaatgcaggtcaaggctcatgaagatgcaggagacggaataccagatacctatgtacccttcagaaatgcaaacctcctctcggttgccaccagttttgcagaggcgcggggggccgatgccatctatatcggagtccaggcatcagactattctggatatccggactgcagaccagagttcattgatgcattccagaaggttatcacccttgggactcgcccggatgcaggcattatcctgaagacgccctttgtaaaactcaacaaagcagagatcctgaagatagggatggacctgaacgttccgtacgaggatacctggtcctgttatgcagagaacgaggttgcgtgcgggatatgtggatcatgccattatagactggaagcattcagacagattgggatacaggatcccatcccctaccggtaaattatggagatatatcgcggacgcaggctctgggttgaaaagcggggctttcatctcccggatgggcgggagaaggaggcgattgtcgtccatcccggtgatgcagtcgtcatactcccccatgaaggagatgatattttacttatcaggcaatggagatctcccattggcacctatatttttgaagcgcctgccggaaccatggaagaaggtgaagatccgatggagactgcaaaacgggaactcatcgaagagaccggtatggctgcagggtccatgcatgccttaggatatatctatacaacaccaggctttaccgatgagcggctctggctctttgaggcaacagatctggtcccttcaagggaacattcccctgatgatgatgaagtcattgagccggtacgggttactgtaccgcagataagggagatgatccgaaccggcgaaatcgtggatgcaaagaccatttgcatcttttaccggtggatatgcgagcgttctgatgaataactcatacctttttctggtcctgattcttgccctatccctcctgactgcaggctgcatggatgcgagcaatgaagagaaagtgattgcatcatggaatctctctcctgatggcagcatcggattctcagttccggagactgttattgaagaacgggtccttgaagaaggaaggaacctgatcagtaccgacctgatattcaaggggtttgccggggatgtacatgccatccttgtcagtccaaaaaatccggctgcatttctggtctgggctccgggtgccaacaatcccgctgccggctatgctgaatacatgcattattaccctgagcatggaattggggtgctcattatggatgtcaggggaaatggtggtgcaacccccggatacccgatgaatattgaaaaagatgccggactctttatgcagggggcctggccggagttttacctgattgcggctgatatgatctccgccaaagagtatctcaaaaaaatatatccggatattccgatctatgcagtgggagattctaatggggggcggtatgccgcactcgcagcaggttctgatccagattttgccggatatatcgggatctccacatcaggttttcaccacattggagaggagtatacatctcccatcagggaatttctcctgagcattgatcccgatgtccaggttgccaggatagcaccccgaccggtcattctgtttcatgcccctgatgacccggtgattgcttttacagagggggaaactctggcagtatcggccggaaaagaagcaatcttcatccccttcaacgggactcatggagtaaacagggaggttgatgagaggatcatcgccctcgtttcgccttcatgaagttgagcaggggcaacggtgaaccttaagtcagcctcagatcaatatataccagcttatactgtaggatagtctcatgagcgaagcggttgaactggacgaagcaagacggaaatatgaatttaaaaagatgcttgagcgtctggaggcaaaggaagggagtggaaccgaacttatttctctgtatattcctcctgacaaacagatctttgatgtaaccgcccagctcagggatgagtttggccagtgtgcgaacatcaagtccaagcagacacggaccaatgtccagagtgctatctcaagtattctttccaggctcaaatattattcaaagcctccggagaatggaatagcagtcttttgtggtaccgttaataaacacggggaccggcaggatcttgagtgtgatattgtaaatccacctgaaccgctcaacctctacctgtacagatgcagttcccgttttgaactggaaccactccgggaaatgcttgaggagaagtatgtgtatggcctgttggtactggacaggcgtgaggcatactggggatttttacggggaaaccggattgaccccgttggtgggacaacatccaccgtcccaggaaaacagcggaaaggtggtcagtcaagtatccgttttgaacgtctccgtcttatcgcgataaatgaattttataagaaggtcggtgagcgtgccagcgagatattcctcaatgagaaggacttttttaaccggttcaaagggctactgattggcgggccctctccgacaaaggaagagtttgaagaagggaattttctgcatcatgaagtccagaagcggatcattggactatttgatgtagcgtataccaatgagagcggtcttccggaacttgtcgaagcggcagaagatgcgctgaaaggtcaggaagtcattgaagagaaacacctcatggaccggttctttaaggaacttgtcaaggataatggtcttgctgcgtatggagaacagtcaatcagggcaaatcttgagatcggtgcggtagacacattgctgctatcggataaactgaggaaaagccggctctccataaaatgcgacgcttgtggatatacagaagagaagaccgtccttattactcctggcgaaaatccggaggatatcgaacttggctcctgtccaaagtgtacgtctccgttggtgcttgctgactcttcagatattgttgatgaactgacctatcttgccgaccagtccaacagcaaggtcgcaattatctctgacgacttcgaagagggatcacagttatttacggcatttggtggtattgccgcaattctcagatacaggacaggatactgatgtaccgcacaacgtgtgatgcaattgctgcaatactcaggcagcatacaggaaaagaagatgtcatgctgacagacggcggagatcatgccgatgtcgcctcaaccattgcattttccctggcaaaagaacttagaaaagctccagccataatcgcccaggagatagccggagcaatcagtgatcaggtaatggctgagaccggtgcagagacccgggctgtcggcccttatgtcaatttcatcttcggagcagaatactgcatgaacgtgctggagcaggctgtccgtgagggatacggaaaagggcaggaaaaatccgagcgggtggttctggagcacacatctgcaaacccgaacggcccccttcatgtcgggcatatcagaaacactataatcggcgatacgctggccagatgcttccgaaaggccggttatccacttgaagtccaatactatgtcaatgacatgggcagacagatagcaatagttgcctggggaattgcaacccagggggcagatatccatgccgaaggaaaaggcgaccatctgatagccgatgtatacatcgaagcaaaccgccatcttgaaaaagaacctgctctcaatgcagagatcgaccggctcatgcaactggttgaatcaggcgatcctgatactatcagccagttcaagatcccggtgaaacgctgtctggacggatttaaagatacccttgccgccatgcacgtgaagcatgaccggtttatctatgagagtgactttatccggaatggcgatacagcaaaggttctttcccggatctcccacctcccagaagcacggattgaggagaccctctctcttgacctctccgcatttgggtttgaaaagaattacatcctgagacgctctgacgggacaagtgtatatgccgcgcgtgacattgccttccacatctggaagggccataactttgaccgggtcatcgatgtcctgggtgctgatcacaaacttatcgggactcagctgcaggcaacccttgagattctgggtgaacgggtgccggagatagtcttcttcgagtttgtctctcttcctgaaggatcgatgagtacccggaaaggaaaattcatctctgccgatgaactgattgcagagactgaacggcgggcaatggaagaggttaccgcacgaaggtcagaactctccgaagaggaacgcaaaaagatcgctcactctgttgcgatatcagccatccgatatgatatcatccggaccataccagaaaagagcacggtgtttgactggaaagaggcccttgacttcgaaaaacagagcgggccatatatccagtatgcccatgcacgtgcctgtagcattcttgaaaaggccgaatcatatacaccctgttttgaggcagaaggagaaggagagattgcactcaccaagcagatagctctgttcccgaaagttattaccgaggttgtcactgagctgaaacctcatcttcttgcgatatatgcccgtgaacttgccgatatattcaactcattttatcatgctgagccggtgctcagggcagaaggaaagatcagggaccggcggctgactctggttgatgcaacgagaaatacgctcaaggaagcattggaaacgttggggattgatgcactccgtgcaatgtgaccagtcaaagaaggcactccggaggatgggataccagttcttccatcctgattcttctgctgccctcaaaccctgcctctggtgtaaacgatccctctccggcggggatcagtgttataagaaccagttttacggcataaccagtcaccggtgtgtgcagtttaccccgacccttcggtgtaatcatacttgtcttttctgctggcgctcatttgagcatgagtataccggtgaaaaagatctcctgccacaggagatcgtatcccgcattccatttctccagaaaaaagccctggggggatataaagtctcaccaaaggttactaaagagaaatgggaggaggcattacagcctgaccagtatgccatctctcttgcaggagagccaaccctctatccgcacctgcctgaactgattgatctacttaatcagacaggaggcacaacatttctcgtatcaaacggcacgatgccggatgtattgaaacggtgccatccgtaccagaagtacatctccctcaccgcccctgaccgcgagacttatcttcggattgcacggcctcgggaggactattgggaccaggtccttgagagtatctcgtgtctgggacatgaaaccgatgcgggagaccggactgctatccgtgtcacccttgtcagggggatcaatgaccaggatccggaggggtatgcacggattattcaggagagcggtgcacaatttgttgaagtgaaggcgtacatgcatgtcggatacagccagcggcggcttactatcaagcatatgccccttcatgacgagattgaacattttacgaagagaatgcttccacatctttcatacagagtcctgggtgaaaacacgttgtcgcgggttatctgtctggagcgagtttcatgatatttgacacagaagagtttaaaaaacgagggaaggaggattttgaatcagcatggcatgcagggccatctgttcttacccccccgacgactgatctgatgtatccccgtctaacgtatttacgggcacaggcccacccggtttttgagaccattcatcggctgagggaggcatacctcgccatcgggtttcaggaggcagaaaatccaatcatcgttgatgaacaggaagtctaccggcagttcggccctgaggcaatggcagttctggaccgggtattttatctgggcgggctcccccgtccgaatgtcggaatagggaaggaacagattcagaagataaactcaattcttgggcgtgatctttcagaggacgaggaggaatcactccgaaagacccttcatgcatataaaaaatcagagatcgacggggatgagctggcctatgaactctccggagtgctccataccgatgatgcccggatcgttgaaattctggaccgggtgtttccggaatttcgtgcattaaagccagagtcatccagacagacgctccgatcccatatgacgagtggatggtttcagacccttggggctatctgggagaaagttccccacccgatacgactcttttcaattgaccggtgtttcaggcgggaacaggcagaagactctcaccgtctcatgagttatcattccgcatcatgtgtggttgccggtgagtatgtgaccattgaggatggaaaagcggttgcacgggcacttttgtcagcattcgggtatactgactttgaattcaggcccgatgacaagcggtcgaagtactacatgccagatactcagaccgaagtatatgccgcacatcctgatcatggatgggttgaggtagcaacctttgggatctattctccggtggccctggcagagtacggggtagggattccagttatgaatctgggacttggggtagagcggatggcaatgatcatgaacaaggcaaaggatgttcgtgaactctgctttccccagttcttccccatccggtataccgatactgaacttgcagcaggtgtctcattactcgcagaacccgctacaacccctggtaagaatcttgtcagatccttgattaataccgcagttactcatagcactgcaatcggtccctgttcatttgtcgcatttgaaggggagattgccggaaaacagatcagagtatatgtcgaggaaccggaggagaacgcaaaactcctcggaccagcctgcatgaatgagatcttcgtccataagggcgcaatccttggtgtcccggacacggaaaagtttgcagaggttagaaagaacgggatttcaacaggaatttcatacctcttcgctgccgcatcacaggctgctgcagagatagagcaggcagcacatttcggtatcccgacaacggttcagataaagatggcacggcttccaggtgatatcaacctgaagattgagccctgggtcatgcgatatattaccgataataatctcaagactgatgtgagaggtccggtatttctcacaatcagatctgaagtgcttcccacttctgaagtatagaaaagcccgataaccatatttttttaaaaatatccagataattataccaatttaaagatattttttcatttgattttattatccgtatctgactcggagcgaggagttcttccacaatacttatctctcctgtgcacaatattcaaacactcaggacacttacgtactcctgatcgaaacatcgggaaaatatgcttctttaggggatgaaatgatggatgggattcgaataatcaggccggcggctatgctggctgttctgctctgtctgctgatgatgacggcaggggcagtaccaccgctgcctgccgaattttatggtaaagtaaccgttgacggaacacctgcttcaattggtactgcgctgatcgcaaagatcaatgatcaggtacgaggaaaaattgctctttccactgccggaacatatggtgggaccggcatctttgatgataaactcgttgttgctgcaaccgaagatgatgtgaaatccggatcggcaaccatatccttttatattggggataagaaggcagaccagaccgttccatttgaacctggtgttgccaaagaactggatctgacggttggcaatttcggagctgactttacggcaaacccgacttcaggagcggcaccacttacggttcagtttactgatacatccacgaccgagtggtcagtatggacctgggactttggcgacggaggtagctcggtcattaaaaacccaagccatgtatacgagactccgggaacctataccgttaagatgaccgtgggctccatgagcggtacctacaccgtcaccaaggataattacattaccgtaacccagtccgggggcattgttgctgactttactgcgacaccgacatcaggaaccgctccgctcaccgtccagttcactgacacatcaaccggaagcccgaccatgtgggcatgggactttggggacggaaccacagaaggaatgattgcaaatccctcgcacacataccagaatgccggtacatacaccgtaaaactgaccgcaagttcagcaaccggtggttccagtaccaaaacaaaagagggatacattaccgtaacccagtccggtggcattgttgcaaactttaccgcagcaccgacatcaggtactgctccactgacagttcagttcaccgacacctcaaccggaggtccgaccatgtggtcgtgggactttggtgacggtacaacggaaggaatgctcgcaaatccctcacacacatatcagaatgccggaacatacaccgtaaaactaacggcaagttcagcaaccggtggctccagtaccaaaattcgggaaggatatatcaccgtcagcccctcgggctccggacccactgcagcctttaccgttgacaagcggagtgggccaaaacccctgactgttcagttcactgatcagtccaccggagggccgaccatgtgggcatgggactttggagatggtggaacctcaatggtcgcatcaccatcatacacctaccaggaagcaggagtgtataccgtcagtctgaccgcctccaacacggcaggatctgataccaagacagaaaaggactatatctctgtgaccggagacataccgcctccggtagcaatgtttgaagcaacaccactctccggctctgctccactgacggtccagttcactgacctgtcaatcggaccgccaacttcctatgcatgggactttggggatggcggaacttcaaccgaggcaaatccaagccacgtatattccgctggtggcacatataccgtcaagctcacggtgaagaatagtggcggatctcacaccatgacccgtgagaattacatatctgttggtggatcaggaatcattgcagacttctctggaacaccgacctcaggaaccgtgccactcaccgtccagttcactgacctctcgaccggcgggccgaccatgtgggcatgggactttggggatggcggaacctcgacggttgcatcaccttcatacacctaccagaccccaggaacctacacggtcaaacttaccgcatcatctcagactggtggcacgagcaccaaggtcagagaaggatatatcacggtctccccatcgggcggtattattgcagactttgttggaaccccaacgagtggaaatgcacctctgacagtccagttcagtgaccgttcccagggtgggccgaccatgtggtcatgggtctttggagacggtggaaccgcactggttgcaaatccggtacatgtatatcagcagcctggcaagtacaccgtcagtcttacggcgagcaatcaggcatcatccaatactgcagtaaagacagattatgtcacggtctcttcaggaccggttggttcaggatcaatcaggataatttacgcacctgatcggtcgtctgtttatcttgataatgccctgaagggtgagacaaaattcctgcagacgttcagaatagagaatctcccggcaggaagctaccagctgaaagttaccaagccaggattttcagattactatgtgaacgttccggttacttcaggcagggcaactgaggtcgttgcagatatgagactgcagccaagccagaatggtatcctgagcgtgtatacctatccggccggatcaacggtgtatgttgatggcgtggaggcaggaactggtccgctctggcttgccgacgtaactccaggtatgcatcaggtacgggtctcctctgcagggtatcttgactggaaccaggctattgatgtgaaaggtggcggaagtgtgaactatgtgaccgccgctctctatccgtcatggtggacacccatttacggatatgtgatgatctcatccatgccagggaacggagtggcctaccttgatggagtggctcagggtaaaactccggttaccctgtcacaggtttctccagggcagcataccatcagaatcgaactgcccggctatcagccttgggaacaggtcgtgaatgttatggaaggaagaacgtcctacgtccttgcccagatgaccaccggtggcagcagtggaacgaccccggtgattgttgcatccgcagggaatacgaccaattaatcttttttttatctttttgtcctttattgaggacagataattgtaaaaattcaaaaaacgaagactatttctaatgcatgggcccgctgagattcgaactcaggatctccgccgtgtgaaggcgacgtcataaccagctagaccacgagccccatgaactgatatgcaccgatcgggagaaattgcggttttagaagctaaactagtgctttcaaacatttgttcttgatgtatataaaccggatcacagttttctactgaattgccggtttggattgccgattgatgccataatggaagggtcccggactgtaacgcgagtagaaaaccggtttttgattctgcctccacatcgaccaaaatatatgattcagatattttatatattgcgaaggatcttcctataaatttgtttttaattgaatcgacagggaaacgtatatagggatagacataaccagattttggttcagttttcctaccttgggtccaaccaagaaaatggggctccatgaatactgagaggcagtaatagaataaaatggcggcggagatcctgagttcgaatctcagcgggcccattaattgaaatattgatatatccagaatctagtgaatatcataatcaatatagacaagataattatctaaaatcaactatttcaggctttaaaacatctttcagaacatctatttgtatttgatattcatatagaattgaattaaatttctcttcaagttgaggccaatctctgtccaattttagtttggggaacaacacctcaattatcatttctcttgtataaaggtgggaacattgatcaagagcgcaaataatgagataataccaaaaggtggctaattgattaccttcaaagtaatattttcgatatactatcgattcttttttaaattcatagtggataaaccaacggtaccaaaatgcacatgcgatgttcagcacccatacaagttcattaatatatgattttcgcccagactgattttccattctcatttcatcaataactagggaaaaggcaggatgtaaatgctgattatgggaaaaatatgtaatatattttttataggattctgggaccgttgagctaataaaaatatcaggctccccccattttagtaatattaagtaacaaaaacccaacagtgacaaagagcattgatgcttttcacgtaatttttcactattggtaattttaacagtaataaattgtttttcaattagagaattgatatgggggcttaaagttgaacccgattggttcaattttttggttaaatcgcttttacttattggaatagggtttttgtcagagtctaaactaagtataactaatccttccaaaatctgcttatcatactttcctgctctttcaagaacaaaatcaacaagatctaatctatttaacataggttcgtttttctaaataaaatccgaatgtttcgaaaatgattaaaatttctgaaattttcgaatatatgccttaattcactcatttatgactaaatatgcttgggttcaatgtttgtatgcccatagatagggcaggagaaattaatgacaaagttagaattcaacacggaaaaagaagccatcagatctactgttgtcgatgaaaaattaaaagaatgccggtttatcctcgttgcgtctggatcaaaaaatcctatagaaaaggagtggtccagtaagaataattattccattgatgacccagtactccaaaaacacatatcatcggggggaaattatggtgtgataccatctagcacaattgcagttcttgatgttgatgaaaaagacatttttgatcgtttggaaatccttgattatttaaaggaaacctttattgtcaagacaggttctgatgatggctatcacatttatcttaaaattaaggacgaatgccctgccaaaaaaattccactctatgatcccaaagataatagcaaacacatcggagagatttttttttcagattgtccagcctttgtagttggacccggatgcacacatccttctggtaataagtatctcatcacaaatgatgcccctattatggaaataacctataatcaaattcaggagatgatactttcaaaggttcattacaagactttgttcaggatgattcttccaatcaaaccacagtgatattcccggatgcaaaggtcaccaaggagggtaaaactctatcagataccctaaatcttgaggtagtgaagattttgcatccagatatgactagacccctccataaattgggagatgaaatttgtgggacacatccaatacatggcagtactacagggaaaaattactgcatcaataccagcaagaatctttggtactgtcatcgttgtggaagtggtggggggccattagaagctgttgcagtcaagtacggtctaattaattgtgagaaagctggcagaatcaagatcaggggtgatttatttaaggatgtaaaaaacgctctcattgaacatgagggttacagagatcagattaaagagctggatgcagattggaaaaagcagaatcgttctcgaaaaggagggaatgaggaggaacaattctatgttctcacgtactttgaaaaagggggaaacttatacctcacgactgtcagtgatgatcaggtctaccaatttgtacacttagatgaaaataggaattacatttttgacaaatgtatcacctcaccttatgggtacacgatatacccgcgtgaattgcccatacatcaggacagtaggatggtaattcctattgtaggtatacctaacggtaatattctcgaaatgaatccagtattggatgcgattagtctctttaatctaataatggggcatatgtccaaatatctcgattctgctaagcatgatctggaaatgtttgcatattatgcaatgttcacatggttttatgtgaaatgcgtaacaaccccatatcttcggtttttaggagatacaggaaaaggaaaaagtcggttcttaagagtggtgtcagatctttgcttttatcctctctctgcttcaggagcatccagttttgcaggcctcatgagaacccatgagaaatggagaggtacacttcgaatcgatgaagctgatcttcgtggtggggctgaaaacccgataattaaatatctaaacttaggttttgaaaaggggcagccgtatatcctgtgtgacaagaatgatctctctcaaggagaatacttcgatcccttcggaccgaaaatcatcgctatgagacaaccattcatcgatgttgctactgaaggcagatgtatttcttattccccttatgaaacagagaggaaggacattccttcagaactctctagggagtattttgaacaggttgagattatcagagcccatttagcagcattcactttacatcattggaatcaggtggatggagaaaagatgattgatctatccactttcaatgttgagccacgattgaagcagatgattagaccgctctcaataatgctccaagtctttccggatggggaaaagaggataacagagtatctcatgaagaggcaaaccgaagtaaagaagactcgttctgaatcatgggaaggaggtatctttaattatgctttgtctttagcgttaggggatgaatttgcagagaatgcacaatttgctgactactacgaggataacgaaattttggtagtaactgcatcaatgatctcgaaaccatttaactcatcaccaaaaagtataacccgtactcttcattctattgggtttgagattgaaagggaccggatttacacgaagtatgatacactaaaaggtaagcaggtcaggaagttagtggtccccaatgaagcaaagtggagagaaattgttcaacggtactatttcgatgagggagaaccacttccaccatcttgtcctaaagtcctcagaggaaaacgctatgtggagtctccggcttaaaggacactctctgtagatatcaatgatgagactggattgaagagatgggattcaacaccctctccaaaatttgaagattcaaatctgtcccttcctaccagtgtcgttattacatctggaacattgagcacaaatagcacggagaactttgaaagtgaaccactagagtatgtaggacaaaccgggaaaaattctctaattccttatgaacaatgtacctcaattgtgccatataagacagttgttccggatcataacgagatcaggacttttcaatcaagctatgattggaaggaattttacgcggttccgattcttgtaagtgctcattcatacacgcggttagttaaatctgatggaaaatggtgcatggtaaaggggtgtacgaagacaccagaatatggaaaccagcatggcatgtatcctctgtgttctgaacattatagagaattaaaaaaccttgagatgggggaattactatgagggagattatcaagaaggtatgtttaggggcggtagcgttattctgtgcgattgttgcagggtgtgcattccttctctcatatacaaatttgcgggagctagcagaaaaagcaggcatttcttcttctctctcccccttatggccaatatgcttggattcattattagtagtatcaagtattgccatactctacaataatctttcgagaaagggttctcttcggctttgggcgatttttattgccttttcattgggaagtttatggtttaacgtttcaaatagtcctgataatcttcaggttcagttggtacatgccttgccgccgtgtgccttatgtgttgctattgaaatcttgacctatatgttgcgatcaaagttagatgagggggacagtctctctcaaaatattaatgatggtttatttatttcagaatctgtgtgtattgataagaattcgaaagcgttacctcattcaacacaattgataggggaaaaagaaaaggtacttgaatatttcattcagaatccgcgtgtaacctatagacaagcgggtgaagacctaaatcttagcccatcaatcgtctctatgagggcgaaacaacttgtagaggaaggttttctggcaaaagaagtcgttttcactaaaaggggaagaaaacctaataattatcaagtagaagaatttttcacatgagaagtaggtccaatttctgggccttctcggataatggatactaaaaaatggtattaaccattttaatattgaaatcccgacccacctttttatctcaataagtggacgttaatggcatatgatatttaaaagagatgtattagtggactcaccgctcacctatgatcaagctcatacggttttatcagaagcgatatttgacctgaagaatttgatcaaatcaggaaggattcgtgatccagaaagggatagagtaagagtagagagttatcgaaccttgattgatctttgtatggattactgttacatgcaaatatatagtgaaatattagaactaagaaccgaattaaatgaaatcgtgagaaaggaggcagcatgaaagcccttgcacccttggttaagcctctcaagcaggtcccttttatgaatattaaaccccaagaaatgggaaagaaaaaaagaaaatcactgaaggagatagaaggtgtccgatcatgaatgtcaaattagaggggaacttaaataagtcctataatggaaatatctgcggtaactatcagtttactgatgaacaggaattaaagattgaaataacgccatatctaataaatgtaaccttccctgaaggattagctttcaagaattttgttgattatcaaaaagaattatattattgggttggactcaaacccacccaatatcgtttgaagaccgaggaaaatactaccattattgagatagacttacctcctccagattgtaaattccggttggaaatgggaaaagaaaacctttgttgggctggttttgaaacaagaaccacaagataccttaaaagatattcactcatccaataacgttagtttttgctgttgtggtatcattacctcattaataattttaatatttttccaaccaatcaagttaaaagaatcacaaaaatattggcaaatagaacccttttcgacataggtataaataaaacctaaaaacgaagatattcacacgatttgaggtttatcattcatttttagtatatatttactagcgtcgacaaaaattttaccgacagatttttggcgaactggaaaagcagaataatttataacactttgtatataatcccatgaaaattatcacaaacaattcctttttgaaaagagataacgggattaaattctttatgatctttgaattaaaatatgcaagaacataataaatgaaatagaacaaatacgatttttggacaatccaagatcgggataaagttcattttcacttcaagaaatgaaaaattagtgataccatgcaaggctttacctatgatctctctgggaaaaatcgaaacaaatgggacgatatgttgaattgttatgaaggtaggtatattaatacaatgagagaagaacaaacttcaagatattttgatatttaggtaattatcaaaattttaccaatttttaagaatattcaagattttttgcccaattctctaaatctatttattcaataatagttggaattaagaaattagacataattaacaaattttctattgattgttaaaaaaattctgaatcctagaattttttctctgcgagtatattagttgggatagaaaatgatgaagtaaaaaaattagaatggaataaacggaggttcatcaccttcattaattatttgggctgtcttataagcatcatatgcacacaaaagaatccaaattggatataaaagaatcccaattaataggaaaattaaaataaataaaattaccgttaacacaatgcataaaaatcctttcccaacttgaccattataaatttgtcctaaacccggaataaacaaacttaaaattcctgctactatggggcttttttcttccatgttactcacataaaatcctaatagtcattcaagtatccacataatagatatattatagatacaaataattggtacgacaataaacaatttatagtcatcgctttatgattcgattataaggatttgactaaatttaattatttgaggtatcaaaatggggtttttagataatattggtaaagagttagacaaagctttaggtcaaactaatacatcaaatggaaacatttctttggtaaataaaactctgaaaatacaaaaagaatttgatgaaaccgaacattacttgaatcaattaaatgctcgttataccgatggagaaattgaacaagaaacatacgaatcattaaaagatgattatgaaaaaaaacggttgtatttacttgatcaagtacgcaagtataaagaagagtttgagaaattacattttgaatccgaatcgatagtaaaacgggttggatttgaaaaaagtgaaatatccagaaatattgtcaaattatctgatgattttgcaaaatctataatttctgaaaaagaatttaaaaattctaaacaagaattggagaataaatcgaaaaaattagatcaaaatttactaaaatcaaaaaagacattgacagaattagaaaaagtaaaaccaatatttaatgcattatccaatcctgaagaataaactctttatttttttctatttagaggcagttgcataataaaattgcggtttgctcaagaacacaattcccactcgattgaaagcacgattcttgagaagtatttttgatttttacctcaacgtattcgtggtatggaattatgcaacagcctcataatcaccatgataaatatctggtttttttgtatactttattgataccactgaactcataatatcatcgactcctaaatttcatatgcgttattttgttatcggtggagctttaatatctacaaaaaggagataatctctttttttttacatattagactattaattgcaagataatagttcaatattaaatggctatcaaaaagtatgagatttctggatataattatatagagaaatctgtcaagaaaggagctaattcaggacgtatttatgtgccgacaaagtggattggcaaaaaaaccgctgtaatattactcgagccagaaaatatttctattgatagcgaataaattgattttcgttgaattttattttcccatgaaaattatcacaaacaattcctttttgaaaagagataacgggattaaattctttatgatctttgaattaaaatatgcaagaacataataaatgaaatagaacaaatacgatttttggacaatccaagatcgggataaagttcattttcacttcaagaaatgaaaaattagtgataccatgcaaggctttacctatgatctctctgggaaaaatcgaaacaaatgggacgatatgttgaattgttatgaaggtaggtatattaatacaatgagagaagaacaaacttcaagatattttgatatttaggtaattatcaaaattttaccaatttttaagaatattcaagattttttgcccaattctctaaatctatttattcaataatagttggaattaagaaattagacataattaacaaattttctattgattgttaaaaaaattctgaatcctagaattttttctctgcgagtatattagttgggatagaaaatgatgaagtaaaaaaattagaatggaataaacggaggttcatcaccttcattaattatttgggctgtcttataagcatcatatgcacacaaaagaatccaaattggatataaaagaatcccaattaataggaaaattaaaataaataaaattaccgttaacacaatgcataaaaatcctttcccaacttgaccattataaatttgtcctaaacccggaataaacaaacttaaaattcctgctactatggggcttttttcttccatgttactcacataaaatcctaatagtcattcaagtatccacataatagatatattatagatacaaataattggtacgacaataaacaatttatagtcatcgctttatgattcgattataaggatttgactaaatttaattatttgaggtatcaaaatggggtttttagataatattggtaaagagttagacaaagctttaggtcaaactaatacatcaaatggaaacatttctttggtaaataaaactctgaaaatacaaaaagaatttgatgaaaccgaacattacttgaatcaattaaatgctcgttataccgatggagaaattgaacaagaaacatacgaatcattaaaagatgattatgaaaaaaaacggttgtatttacttgatcaagtacgcaagtataaagaagagtttgagaaattacattttgaatccgaatcgatagtaaaacgggttggatttgaaaaaagtgaaatatccagaaatattgtcaaattatctgatgattttgcaaaatctataatttctgaaaaagaatttaaaaattctaaacaagaattggagaataaatcgaaaaaattagatcaaaatttactaaaatcaaaaaagacattgacagaattagaaaaagtaaaaccaatatttaatgcattatccaatcctgaagaataaactctttatttttttctatttagaggcagttgcataataaaattgcggtttgctcaagaacacaattcccactcgattgaaagcacgattcttgagaagtatttttgatttttacctcaacgtattcgtggtatggaattatgcaacagcctcaataaaaaactaatttccggcaaaacacaagagaaaagattatgcaccgatcgggattcgaacccgagctattggcttggaaggccaaagtcatacctctagaccatcgatgcagatgctctataacgttgagcatagttgtatttaatatttgtcaaatcaccctgacacaacacttctcaccatcagatccaaatattcacctatgcagatacacggagttctgctggatatcgacggcactttgatgacaggcaatgagcccatacccggagcagagaccgcaatcagatttcttcaggagaacaatattccctaccgatacatctcaaacggaaccaggaagtccagaaaaaatgttctgaaaaaacttgagcgcctgggagtaagggtatccattgatgaaatttatactccggccattgctgctatccagtacctccatgatcgcaacatcaggatctgcaatctcctggttactgatgatctgggggaagattttcaggaagcagggattgtccacaatggagacgcatcaactgttgtggtaggggatgccggtgaccggttcacctatgcatcgatgaacgcagcattccgatcgctcatgcagggaggtgaactcattgctctggaaaaagaccggtactggaaggatgttgacgggctttccttgagtgccgggccgtttgtcaccgctcttgagtttagtaccagatgcaccgcagttgtcatgggaaaaccctccccgcacttttttctcgcggccatgaaggactggaacgtgcagaaaaagcaagttctcatgataggggacgatatcatgaccgatgtgaagggggcgcaggatgccggactccttggggcaataaccctcaccggcaagtgccgtcatgatgagatcaggaattcatgtgtaacaccagatatggagatgaaatcaatagagatgctcccatcacttcttgagtccttgtaaaagatcaggctggtatggaacaaaaataagagtgataatgaggatctacgtataacgtatgagaagaagggcagaatcatgcacaatattcagatgacggatctctctcttgaggatcagaaacgacttgctcttaccggtcttgaagtcgagatgaagaacaggtcaggaagttttttccagaaagaccaggatgtctgtcatgtcacatcggactgtgaaggaattgagttcctgacattcaccatggccctggaaaaatacccatgggtgtctgattatatctggaaggcagtatcaaaagacaaggataaatacacgaggtatgtcgcatcacgacctgatccgaaaggatttgtaataattgcaaaaaaggggacaaaaagtatctatcccttgcaggcctgcctgttcctgtcagattccgccatccagcatgttcataatatcgtcatcgcagaggaagattcagagcttcacatcatctccggatgtaccagttcatcagggcgaaaaagcggagcgcaccttggggttactgagatctatgtcgggaagggtgccaaggtcacatccaccatgattcataattgggggaaaaatattgcagtatatccacggtcagcagctattgttgaggagaacggcgtatttctatcaaattatgtgtgtatggaaccggtcagaaagatccagatggctcccctctgtaccctgaaaggagaaggagcaatcggaaggttttccagtgttgttgtctgcacgcccggatcctttatggacctgggatcaaccgccgtgcttggggcaaaagggacaagtgcagaacttatcacccgggctatcaccaccggaggcaccatactgtcacggggcagaattgacgggaaagtgaaaggaacgaaaggccatatcgaatgtaaggggcttatattacgagacggaaccatccacgcaataccggaaataaagggagatgtcgtggataccgaactctcgcacgaagcagcggtcggaaagatcgcccgggacgagatcgaatatctaatggccagaggtcttgatgaggagactgcaaccgcaaccatcattcgggggttcctggatgtcaaagtagaaggtctgcctgacgtgcttcaggatcagatagatgccgccatagacgctgcagagaaatcaggattttagatggaaagcaggctaacagaacgggaggagatggtacgatggcagatagaagcgcggggtgtgaaaaacccccgggtactacaagccatgcgttccgtcccccggcatctgtttgtccccgaaccatatgcccgtgaggcatatcaggattatcccctgccaatcggaaatgaccagacaatatcacaaccatatatcgttgcggtcatgaccgagctattgtcaccggagaaaggtgaccttattctcgagatcggaaccggttctgggtatcaggctgcgatcctggttgcctgtggagcatcggtcatctcaattgagagaatcccggcagttgccgaccttgctaagagaaatcttacacgagcaggtatcaggaatgttctggtgctctgccaggatggaactcagggatatgcggagaaggccccctacaacggcattcttatcaccgcagccacacccgctctcccagagcctctgcttgaagaactggcagatggcgggagacttgtagccccggtcggggatcgggatattcaggagctgaccagagtgaccagaaacaaagatgaataccatacagagcggttcggagcggtgcgatttgtacccctcatcggtatgtatggatggaaaaaagaatggtaacaccaatgcatccaataaacagtgcagttcaggcattagtgcctatgatggaagagtgtggtattgcagaaagtccggtcctactgacaccggattacgatctccccaaatgcgcctatgaaaaaggagtaccgattcaggtgatatttggagggcgatcagcagtttttgttgctaacgagataattaaagcaactacaaaggcttcctttatgagtaatgcacctctgaaaaaggcatcgcagcgtgccgcagctgcgggtatcctgaatgcagtgaccggatttttgtgcaccaccaggaaactgcacgcctgcaggcaggaagagcattccgaatgcagagcagaactcgccacaaaaatcctgaataaacgaatctattgttatggaaatatgccggatgcacgaaaacttgcaggaaatctcctcgtaaaccgtcctgaagatgcagacgtggttctggtaaccggcgacgggttgatcggggatgacgcgggtatcctctcagaactttccaaagaaaaagtgctctacctcggaccatcaacggttggaactgcacaacttcttcattgtgaacatttctgcccgttcggaagagggaaccttcaaacatctgaagattgaaccaatctggtatgctgttcggttcttccgggatccgccggagatatgatgataccctcatcggtcttgcattgcaggtaggaaaggcggttggggcaaaagccagccgggtagtaatcgggcgggacacacggacaaccgggccgctcatatctgcagcattccgtgcaggcgctcttgcagcaggggccaggatatatgatggaggtatcgctccgacaccatctgtagcgtatggtggcagaaacaccgatgcggcctgcatggttacggcatcccataacccggaaccctacaacggcttgaagttgttcaatccggacggctcttcattctcggccatccagcaaaaggagatagaagagactcttgtggatattccctggggcgactggaaacatcagggaatctccattccctcctatccggcagaagagcatagtactgctattgccagtaaaattcagatcaaggagggactcaaagtcctagtggattgtgggaacggagcaggatcggtcatcactccccgcatgctgagcaggatgggggcccgtaccctcgcggtgaatgcgaatgttgcagggaatttttcacgcccttcagagcctctgcctgaacatctgccctatatcccgtcactcataaaaaaatccggttctgcatgtgcagtcattcatgacggggatgctgaccggatgatggcttttgataataatgggaattttattcccggagacaccttactcattctttttgcaaaatacctcggagcaaagcaagtcgttactacctatgatgcatccatggcaatcgaagaggtagcagaggtcagacggactccggtgggagatgcattcgtatccgaacaactggtccgatggggtgactttggtggtgagccttcaggagcatggatattcccacagatctcccggtgtcccgacggaccgtatgcggcggcactcttctgtgagatggcaggggaatgggatctcccttctgagattgcatcaataccaacgtatccgatacttcggacttcccttgaactagagaatgctcatgacctactctatgctctcggtgcagtaaatccaaccgatggcatacgtatcgaggaagaggacggatggtgtcttatcagggcgagcggaactgaaccgaagatccggtttactgctgaaggaaaaagtttggatatcgcgaaaggactcctcgtgaaaggtgaggatatggtcaggatcatacgaaaagaggtcaagcagtgaccgtctgtgttatcctcgcagccggtgaaggcaaacggatgaggccgctcaccggttccaggccaaaggttatgctcccgcttgccggcagaccaatgcttgaacacctgctgaatgcagtgatggatgctgggattaccgattttatctttgtcgtcgggtatggtgaagcatcagtcaggaatttttttggtgatggaacatccaaaggaatctcaatcaggtacgtgacccagaaacggcaacagggaaccggcgatgccctgatgaccgtcaggccccatgtccattcgcaatttctcctgttaaatggcgatatggtcctgcactcagatgatatcaaagccatgttgaaaaccccggccccggctatgggggtgttcacctccaatcatccacaggattatggagtggttactatggacggggatatcatcaccggtctcgaggagaagtcccttcacccgaaaagcgaccttattaatgccggtatgtatctgttcgaacctgggatttttgaagaacttgaaaccatcaggccctcacccaggggagaactggaactgaccgatgctcttatgacgtatatccagaataaaactctccgtggggttcgccttagcttctgggcagatatgggatcaccctgggatctcctgggggttcatgaagagatgatgagagagatcattccggaacatcagggagttattgaagaaggtgtcatcatcaagggagatgttcagataggatcgggaaccgtgatcatgtcaggctcataccttgaaggcccatgtatcatcggtgctgactgtaagatcggcccgcatgcctatatcaggcctggaacagcaatcgggaacgcctgtcatatcgggcatagttcagaaataaaaaactcaatcatcatggacaaaacaaatgtcccccatttctcctatgtcggagacagtgttatcggaagcggctgtaaccttggagcagggacaaaaattgcaaatctccgccatgataaagggactatcatcatcggggggacagataccagaagacgaaaattcggtgcggttatcggcgatgatgtcctgtttggcataaactgttcggttaatgtcggttcgatcatcggtaaccactgtagaataggcccgcattccctggttgaagggaaacttgaagatcatacggtgattcgccgatgagcctgcaggcagtcatcctggcagccggggaaggggtgcgactccgcccgctcacgcagaacaaaccaaaagctcttatcccggtcgccaataagccaattattgagcatacaatcctgtcacttctggaagcagggatacgggatattatcgtcgtagtcggatatcggaaagagcaggtaatgcggcatctggcacatctgagtgtgccgatcatgatcgtacggcagaccgagcaacttggcacagcccatgcactcctctgtgcacgtgaccggatcgctggagacgttcttgttctccccggagacaattacatcgatcctgactccatcagggatatcgccaggataaaaaactccctgttatacactacacaccgtcagccatcaaacttcggggttgtcaccattgaggatgatgcggtttccagtatcacagaaaaaccggttcttgcaagtaggatgacggtcagttgcggagtataccatctgggatctgagctcctcgccagaataaccactcaaagtctcagtgaggcaatcgatgaagaaatcagacgggataccaggattgctgcagtaaaagctcattcctggcaggatgccatctacccctgggacctccttgtcatgaatgatcgtctcctaccttttatatatcaggaaaaatcgggaattatcagctcatcagtcaacatgcagggaaaggtctccattggatccggaaccaaaattggtcctggaaccgtgataaccggaccggtaatcatcggagaggactgcaccatcggaccgcatgttgtcattgaaccggggaccagtatcggatcccgggtgaagatcgaaccattcactgtcattcggagatctatcctcatggatgatgtggttatcgcatctcatagcagcatttcaggatcggtcatcggagagggatgcactcttggagagtatacatctgccatatatgccagggggtttattccatcagaagactctgcgatccgtgctggatgcggagtcatcatggggaatggtgtcttttgcaaaccctcagtcatgtttgagaatactatcgtcggcaatgaggtgaccattgagggacgaacagatctcagattctcctgtacccggattccggataaaacccgggtgatataggatgtgtggcattgtcggatatgccggttatcggcgtgctgccccaatcctgctccagggtcttcgaaggctggagtatcggggatatgactcttatgggatagcaacccttgcatctgaggtatgtgtccacaaaaaggccggaaaagtctctgaccttcctgattcacagggcatgttgcagggaactatcggaattggtcataccagatgggcaactcatggtattccttcagatgtcaatgcacatccacaccaggactgtaccgataagattgcggttgttcataacggaataattgagaattatgcacatttgaaacgtgagcttattggaagagggcataccttccgctcagagaccgataccgaagtgattgcacacctgattgaggaggcatatgcaggtgatctgcttgaagcggtcagaataaccctcccactcctgaccggatcctatgcattactgattatatcagcaggtgaagaccggcttatagctgcacgaaaccagagccccctggttcttggtattggggatggtgagatatttgctgcatcggatatcacaccgcttcttgagtatacctcaaggatcatttaccttgatgatggtgatattgcagaactcaaaccagattcatattcggtttactttggggatagtcctgcagaacgtgagatcaaagagatcacctggactccagacacggtgcagaaaggcgggtttgcccactacatgctcaaggagatctttgaacagccggatgccatccaccgggcggttcacgccgtttctgaagagacactgccatcttccctacgtcaggcatcctctattactgttgtggcatgcgggagctcgtatcatgccgggatgatattccggtacctcattgaaccggtatgcggcatcccggtcaggctggagctgggttctgaatataagtataccccggtcccgttcagtgatgtgatcatcggtatatcacagagtggtgaaaccgcagatacactttcagcaattcgaaaaggaatctgcaataatgtgaaaactgttgcgataaccaacgttctgaatagttctatcacccggagtgctcatgacactattctgatgcatgccggccctgagatcagtgttgctgcatcaaaatcattcatcgcccaggtaggagttcttatgcagattgtgaatatcctctccgggggacgatgtcatgatattcttgaccatgccaggtatgcacttgagcaggttctcctgaccgatctgactgaggcagtagatctctgcagtaaggcgcagcatctcttttatgtaggacggggggtattttatccggtcatgatggaaggggcactgaagatgaaggaaatttcctatatccatgccgaggcgtatgctgccggagaactcaaacacggcccgttcgctctcttatcccccgatactccggtaatcgccatatgcacccccggtcctgcatacgaagtcatgcttgggaatatgaaagagatgaaggccagggggactcccattgttgcatttggaaatgaagacgacggggatgtcagcgatattgcagatgtggtaatcccgcttccaaaagcacatatgtggacccaggttctaacatctactgtgctcttacaactccttgcgtatcataccgcaaaccggctgggcagagagattgatatgcccagaaatcttgcaaagagtgttaccgtagaatgagaaaaaacactcaccctattatttctgttgttggcccgtcgaccagatttctatcaggtatcagttattataccatcagactctgtaatgccctgtctgaaaaaagtgcagtccatgcagtactatttcggaatatgctcccaaaacggctttttccgggatggaagcgggtgggtgtcactaccagctcagtcggcttttcagatacaatagatgtcgctgaagttcttgactggtataatcccttttcatgggcaacaggggctcagaggatcaggagatcggatgtggtcatccttgaatggtggacatccagtgtcatgcacatgttccttgccctgctcctgctctccggcaggaaagccaggataatcattgagtttcatgaagtagtagatcccctggagtacgccatccttccgctccggatgtacgcaaaggtgatgggcaggatcatccggcgaaacgcttcccggtttattgttcactcagagcatgaccgggagctgattgcatcccaataccggatagatccatcccggattactgtaattcctcatggactctatgaccagtatccgattctgagtaaagaagagagtaaattacagctcggaatcgggggaaactttgtccttttattcttcggtctgctcaggccatacaagggtgtatcccatcttattcaggcatttgaaaaactcccttcttatcttcttgaggagaccgtccttgttattgccggagaggcctgggaagaccaggagtctcttaatcgtatcaaagaatcaccagtctctgacaggataattcttgaaaaccggtatatttcagatgaggatattccagtgtttttttctgccgcagatctcctggtgcttccctatacccgtgcctcccagagcggggtagcccatatcggcattgcatacggtcttcccatactggcgacacaggtgggaggacttgttgaaagccttggatcctatgcagggaccagatttgtcaggcctggtgataatgacgggcttgctgatacaataaaagatctgatactccacaaaagtcaggatcggtacgatccccctgaagagatgagatggaacaggattgcagagaggtatttgaacgagatagtcaatcccgttcaggagaagatatgagaattgcaatcctttcctgcatggattttaaaattcctggcggtgcagagcggttttttattgatatggcacgggcattggatgcaaccatcgtctgcttgtcggtaagtgatgatttgcgcaccatgtatcccgatgctgaacaggtcagtttctttccgcttcataaaacacttcctgacgagcctcttcgccagatagcaggaatgagattatttaaaaaactcagcctggattatgacttttatatcgccaccgatgatatgtctctccggtttctgtcagagaagatcccacatgcgtacatgatgctgacgccgcgacgggcattgtatgatatgtattatcctaccctggcatcaaagccagtcgggaaacggcaattgttcatgattattctctgctttttccggttccttgaccgaaggtttgtcaaaaagcatgtcagatgtattgcaggtatctcccataccgtcagaacaaggatctggaaggcttatcaaaaacctgcaacggtcatctacccgcccatacatctggaaaaatatcagaatctgggatatgatgattactggctttcggtcagcaggattgataaatggaagaggattgaccttcagattgcggcatttcgccttcttccggataaaaaacttgtgatcgcaggaaagatatatccggaatttgaacatcttgttcatggagccccgcaaaatgtcacttttcttggcccggtgcccgatgaggaactcctgaccctgtatggcagatgcagagggtttctcacaaccgctattgatgaggattacggacttaccccacttgaagcaatggcctgtgaaaaagcggtggttgctgtgtgtgaaggtgggtaccaggagaccgttgcacatggatataccggttttctggttgccccacatgctgcggatattgcgaaggccatcaggaatgtggatactgatccctcccggttcggacatgaggcacgaaagagagcagaactttttgattacaagatatttaaggaacaaattaaaatgtatgtgcatacctgctttgaggaatatacatcagaaaaagaccagggatccatggggagtactactgaatgaattggaatgataaaaatgtcctgatcaccggtgtcagtggatttgccggttcatatcttgcccgggatcttctggataaaggggctcgggtctatggcatggtgcgaaggcggtcagatggcactataccaaagaatgtgtcacaaaagaagatcgaacgggcaattacctacgtggaagcaggtcttgaagacctgaccggtattgcaaatgcgattgatagtgcagaacctgattacatctttcatctggccgcccagtcatttgtcccgagatccttctcccatccccttgagacagcccagataaacggacttggaacaaacaatctgcttgaagcagtcaggatgaaaggagcagacccggtgctggtctttgcgggaaccagtgaagaatacgggcttgttatcagctctgatgagcagtataccagactgaaagagaaatacgggaatatcttccctgaaccggatacgatcccagaactcccgatacatgaaaataacccgctcagacccatgtctccgtatgcagtctccaaggtatatggggattatctcttcaggaattatttttacacctatggcctgaaaggaattgtatcacgggcatttaatcatgaaggggccgggaggggaatccagttcgtcacctcggtcataaccagccaggtcagtcatttcaggtgcaatgaggcggataaaatcaccatcgggaatgtgaatgcatttcgtgactggtcacatattgatgacatcgtgcatggttatgagctccttgccatgaaaggaaaacccggggatgtctataatcagggatcaaacagaaccacatcagttctcagctacatactccacagcattgaggcatgtggtatgccggtcaaggagatctgcacaaccagaaccggaaagtgtctgaaagatcccctggagcctgacaatgaggcactgtttggtgcatattttgagaaatcaaaagttgaccggatgatacttgacggcactctggatttcggaccacaggatggtgggattcttgtcaggacagctgaaaagacaatccctattgaatttgacttggagcggttcagaccatctgatgtcccaattttgtttgctgatatcagaaagatcaaacaattaggatacgaagtaaggtaccagatcagagacattgtacaggatcagatgaatttctatatggacccggagaacagatgtagtattcatacgattgaacgagcgtgatgagatggaatattcaagatatctaaaaccctttactctcatattaggagcaattgttctcctcattacttttttttcatttattatcagaactcttcctgcatactcaggaactaccgatgtgctgatgtttgtcggaatggatgatccgacctatcagttgcgcaggattgaacagattatcgcaaactatccaaatgttgcctggtttgatccgatgacctacttccccatcgggcagcccatgcattggggaccgctcttcccctttctcggggccactatctgtctgatcaccggggctgccaccagaacagagatcatctctgtttcactcttccttccctgtgtgatggcagcactcatggtcccggtcatctatctcctggtcagcagggtagctgactggaaagccggccttgcagcggcatttttcatcgcaattgtgccagggcagttcttcttcagatccttttacgggtacctggatcatcatgcaggagaagtcttttttagcacactcttttgtctgtgttatcttactgcactcgtttacagcaggaagcatccggtcgatctcaaagataaggagacttggaagattcccatattccttggaattttatgtgggatcacctatgtccttggacttgccctgatgccaaccatgttattgttcgcccttatcgtcgggatcttcaccccggtctggtttattatccagcgatatatcgggcatctgggagcatcggcactggtcattaattcggtaacgttcctcgtcgcaatcatcggttttttcttcatcggtgtgcattcagaaggagggctcaattattacaccatcgggcatcctatagcctatactctcctgattctggcaaatgttctcctctttggattttcttatcagcttcgggacaagccctactggtattatgtcggagccattatcggagtaactattcttggtattattgcccttgcagtcatccttcctgacctttttgcatacatgatggcaaatgccaatgcattctttggttctgatgatattcactggaagactattcaggaagcacgaccctggagctttgatgatgcgtggaggacattccagtacagtcttcttctcttcggtgcaggagctgcggttctcctgtatcggatcagaaaagaactctgcccgtcccatgcgtttactctcatctgggcggtcgtgatcttttacgcaacctgtcagcatatcagatatgagtactacctggcagtaccggttgccatattggcaggaattgccgtaggatttgctcttgatatcatacggcttcccttcggacaaaaacctgaaatctcgccaatggatgaggaccatcagtcaggtaagaaaaaagcagggaaaagccatgacgtatcacgagggagatccggccacccagcaggatcagtgaaagccggatcttacttattcctggcgattattctcattctggctctcctattctcatatcaggcactgggccgggatctcatgatgggggcgtacaacctgaacccggactggagagaagcgactgaatggatgaacaagaacacccctgatcccggggttgattattttgcaatgtatgatgagaagaatttcacctatccggatagtgcctacggggtcatgtcatggtgggattatggacacatgataacattccttggaaaacgaatgcccaatgcaaatcccttccagtacggggtgaacgggccgaatggatctgccagattctttatgacgaagaacgagagtgaggcagatcagatacttgccaatctgaagacaaaatatgtcatcaccgattatgagatggataccgggaaattctgggccatgtctacctgggatgatccggaagtcggtgtctatccctaccagcggacctttatcttcccaagtccggatgatccaaaatcgggagtcaactatccgctgctcaccaatgagtactaccagacgatgatctcccgtctccataactttgacgggacatataccgaacctggtaatgtatacttcctgcggtatatgaaaccctcggctacgggcctgaatgcaccggttgtcgttgatggagggcagacgaactattcagcaggaaaagcccttgtgaactcatttaatgcacaggaaaatcctcaatacgatgtcatcctggccaacttcggatacacggatccggtcgagccagtcccagcactcagtcattaccggctcatctttgagtcaagtaccaggactactcctgcagatatgcatgatctacggtatgtgaaaattttcgagcatgtgaaaggggcacagatacctggtgagggcatgctggaattaccggttaagacgaacaccgggcgggaatttatctatcggacacagagtatcaatggtacctttactgtcccatatccgacagagacaaccgttggtgcggttacaatcccaggaaagtaccgcaacaccaaaaacggagctgaataccaggtcactgaaaaacaggtaattgaggggcagagcatttaatatatgcagaggaatagggagagtatgaatcctgagatactggaggccggagtgtttgtgcggtatcctcgcaccggaacctccggaacgatcacacggctggttgacaagaacgggagacattttgctgaactggattcaaccggcctgttataccggcttgaccagttgattcctgctgaatctgtccagaagaatgagcgtgaaattgaccgcgatgaacagcttgcacggctggaacaggaaagaagtcaggttgagaaagaagcaatggaagaaccaccaaacctggatggtgcctgcgccggagcaggataatacaggtggatgtacaccggtttcaggtgtatatgaacatgatggggaacgcacctgttcctgctatctgcggttatggctataagtatgatccgatggaaatacgtaaggaggttgaatagctggtgccagaagaactgattccaaatacaaatattggtgtggtcggtcatgttgaccatggcaagaccacactggtaaataccctcaccggcgtctggactgacagacatagtgaggagatgaaacggggcatatctatcagacttggatatgcagatgctgtcttttaccgttgcagaaaatgccgcggacctgagggattgacaacaaccccggtctgcacgagatgtgacagtgagacagaacctattcgtgctgtttcttttgtggatgcacccggacacgagacgctgatggcaaccatgctctcaggctctgccctgatggacggtgccatgctggtgatttcagcagctgaccggtgcccgcagccccagacaaaagaacaccttatggctcttgaactggtcgggattaaaaaaattgtcatcgtccagaataagatcgatgtggtctcccataaggaagcaatcaggaattatgaggagattaaggcttttgtcaagggaacgatagcggagaatgcaccaatcataccggtatcagcacaaaaaaatatcaatatctgggcactgattcaggctcttgacgaagtcattccagaaccatcacgccatccggaggctgatccggtcatgctcatcgcccgttcatttgatgtgaaccggccaggatgcagctggaaagatgtcaaaggcggtgttgtcggtggttcgcttatcaggggtcttattgaggatggtgccgagattgagatccggccgggtatccagaaccaggtggagaacaagaccaagtgggagcctatcatcaccaaggtgacagagattcataaaggacagaagaaagtccatgttgcaactcccggaggtctccttgccatcgggacaaaactcgaccccgcgattaccaaaagcgatatgcttgccgggcaggtcctaggtcatgtcggaaaactcccgccggtctgggagaagatgtggttctcagtgaaacttatggagcgggttgtcggctcaaatagtgaggtttccattgaaccactcaaacagcgcgagcctttgatgctctctgtcgggactgccgtaacagtcggtctggtgagcaatacccggaaagatgcagcagaagtcgttcttaaacgtccggtctgtgccagcatcgggtcacctatcgctatcagcaggcaggttggtggaaggtggcgactgatcgggatgggaacgctgatcgagtgaccatccttatcgacaccaatgcctttcttatggcatcacaatttaagatagacctccttgatgaactgaaatggatgctcggctcggtcagaataattgtgccggagatcgtgatcagggaacttgagggactggcaaggggaaaagggaaacatgcagcatcggcacgtcttggactcctgttcgcacagaaatgtgagatcatcgcatcatcaggacaaggcactccggacgaacagatactgatgagtgcgatggatctccagtgtggtgtggttaccaatgaccggagacttcgtgatcaggttcttgatgtcggcctccctgttgtcagtcttgcaggaaaacagaaattagagttgattcggagataagagaatgtattaccggttggaactgattgacaaggtgcgtgttcctcctcaccggcttggggaggatctcacaacggtcattctggatgtgctgcaggagcagctggaaggaagtatcgacaaggagatcgggatttttatcgccgttaccaaggttctccggattggagaaggggagatggtccccggtgacggtgcggtctactatgatgtagactttgaaggtctggctcttcgtctttctcttcaggagattattgaagggattgttgtagaaaccaccagttttggtgcgtttgtcagtcttggaccgattgatgcgatgcttcacgtgagtcagatatctgatgaatacatcagttatgatgagaagaactcgcagctgatctgtcaggattcaggtcgtcatcttggtgtcgggtctcttgtcagggcacgggttgttactctgagtctcaacgaacgtgaacctcgtgaaagcaaaattggtcttaccatgcgacaggctggtcttgggaacctagtctggcttgaagaagacatgaagaacgaacagaaagagaagagtgcggtttaaacatggctagcgcaaagaagaaacaacatatggtctgtcgtgactgtcaccgggttgttgaagggacatcctgctccatctgtgggacctccaatcttaccgcagactggaccggatacctggtcatcatcgatccggagcatagcgaagtagcccgccggatgaatatcaccctccccggaagatatgcccttaaggtccgttgatgcgaattcttcctgcccggcaccgtcagttatttaaagaaccatttggcaccctttttcactcttttgaggaagttctcaaatttttaccaggaaaaaccgtatttagtgttggtgatgttgtcaccgcaaatctgctcagggctggccggcctccagaggttgccattgtagacgggcataccatgcgtcagccatatccgggagtgaacatccctgagtatcatcagctgctggtaaaaaatccggctggcggtcttaccgaagacctgattgatgcaacacagatagcagcatctcgtcaggggacggttattcaggttgaaggagaagaggatctggctgttgttccgctggcaatgcacgcgcctctgggaactgtcattctctatggtcagcctggagaaggagtcgttttgctctcaattactccggcaatgaagaaaagggcagaagagctgttcacctgttttgaagaggtcagcaccccgacagcgcgcgaggtatttaacatctgacaggcaacctaatacggatctctatggagattacgattacttcacaaacagagaatgttctgttaaaccggaaagagatcgggtttagcatcacatttaccggagcaaccccgtcacgcaagatggtccatgcgaaacttgcagcaatgctcagcgcaccaaaggatcagctggtgatcggatcccttcacaaccgtttcggattaactgaaataacaggcgacgcacgggtgtacacctctgctgaatacctgaagaagatcgaaccggagtatatccgaaagcggggtatggccggagaagaagaaggcaacgcagatgctcaggatgcaccgtccggtgacgctgcggaggcatcttaagggggacgatgaaatatggcagcaaaaaaagcaaaaaaatcagagaaggccgcagtcaagcggtcagcctatttcaaggttgaaggaaagaatgcagttcctcaacgcaggtactgtccccgctgtggtccgggcgttttcatgggtgaacacaaagatcgtgttacctgtggaaagtgtggatacactgagttcaagaagtaaccctgatgaagatcggacctgtactggggatcgagggtacagcctggaacctcagtgctgctctttttgatgatgacctgattaaactggtctcacatccctacaaacctgtgcagggcggtatacacccgcgtgaagcagcccagcatcatgcatccgtcattaccagtgtcattgaagaggtcctgaaaggaaatccgactccggtagccgtggctttttctcagggtcctggtcttggtccatgccttcggattgtcgggaccgcggctcgggcacttgcactatcctttgatgttccactcatcggcgtcaatcattgtgtagcccatgttgagattggaagatttgcatcaggatttgacgatccggtcgtcctgtatgcaagcggggcaaatacccaggtgttgggatacctgcagggcagataccggatatttggagaaactcttgatatcggaattgggaatgccattgacaagtttgcacgaagtaaggggcttccccatcctggcggaccggaaatagaacggattgcaaaaaacggttcatacatccctctgccatataccgtcaagggcatggatcttgccttctctggtcttgtgagtgccgcaaaagatgcatcagccccccttgaggatgtctgttacagtctccaggagacagcctttgccatgtgtacagaggtcacagagcgcgcattgtcacagaccggaaaagaacaactgatcctcgtcggaggtgtcgggatgaacaagcgtctgcaggagatgctctcctgtatgtgcgaagaccgtgatgcagcgttctcagtcccgaacccccagtacctcggggataatggtgccatgatcgcgtatacggggagggtcatgcttgagtcaggatcagttctgccggttgaggagtcacgggtgaatccctcataccgtgcagaccaggtcctggtcacctggagagaggaaccttctggttctgaacggcatccggatgcatatagtgcacggggcgcagaggccatcgtccggttctgtgatggagcagcatccaagatccgggtatcaaagcgataccggcatcccgaactagaccgtcgacttattgcagaacgaaccagggctgaagcacgacttatcgctgaggcacgaaaagccggggtcaggactccgatcatcagagagataactcaggataccattatcatggaacatatcgacggggtgaaactcaaagaatgcctctcaccagagctccttgaggagaccggacggatggtcgggaaacttcatgcagcacagattgtgcatggagacctgacaacctgcaatttccttgtacatgacggcaagacctggcttatagattttggtcttgccggaacctcatctgatatagagcatcgcggtgtggatattcatgtcctcttccaggtccttgagagcacatctaaagattcagacattctgaaagaggcgttcatccagggatatcgggagaagatgcctctggcggatgagatactgaaccgggagcatgagattgaactgcggggaagatacctgtgagaattacgtttgttaccagcaatgaacacaaggcacgggaagctgcaggaatccttgcaggtcttgccgagatagaacatgtccccctggagattccggagctcaggtatgaatcggtggcagagattgcagcgggaaaagcagcgtatgcctactcggtcctgcagcggccggtcatcaccgacgacaccggactctttatccatgcactcaatggatttcccgggacctgtgctgcctatgtccagaagaccatcgggaataccgggatcctggccctcatggcaggatatgcaaaccgttccgctacatttgagacagggatagcctatcatgacggggattgccagagatcattcaccggggctatcaaaggaactatcgtccttccccggggatgtggaggattcggatacgacccagtctttgaagtagatggaaaaaccctggcagagatgacagaagaagagaagaaccggatctctcatcgggctatcggactgcatgcattgcgaagatggcttgctgaagagaagcagtaagacataacccttatgtgaggatacaaccctgtatataagacagatatttacggagatatcatatggcacgttttcctgaggcagaagcacggcttcttaatgttaagatttgtatgcactgcaatgcccgtaacccggtcagggcagtcagctgtagaaagtgcgggtatgtacacctgcgtccaaagaacaaggatcggaaagcctgatcattcaggctgaataaaacgttactttttttccttttgcactatattctcccttgaaggtctcaatattccgtttatacccgatcctgtctgtaattcctattctgcgaagttcttctctgacacgcatcacatccgcttcatcttcccagtccgcagtatagacatagatgactttccgatcatcacgggcatccggatctggttttgccgtcgacacttttgcagaaatgcctaaagttccttcccatgtccggtcacggatctgacgccagatatcatccacctgatcaggcgggagaaataccagccattttccggccttttcaatgtccgcagcccgaccatcgacatgaggcgaatcctgttcaatccaccttgcctgatatgtcttgcttggaatgacgccttccccttcacgaatcatccggtatatctcttcaggagattgaaactggctgatgagcagatcgtatacttccggataaacggtagagaattcggtaaatatttcatggaacagttcttcgaaaggctcaccgctctctacgatgagagaaagggattttttacgcatatgcagctggcttctgaaaaagaactcaaaaatggcatatgcgctgtccgagagttcaaccgtatcagctgcgtccatactcaggaataatgcctgacgggaaaaaatagatattggttttatctaaaacagggtgctgttcggatacaacatgataaggccgcgccatgcttcttcagcagcatcttcatcagcatcagcctgtgctttcagggagttgcgggtatctttattatgtgtcgcaagtccgctgcttttcccaagttcttcatttgcttcactactggataccaggtaaaagagcagcttggtgacattgaatgcaaccggataaaattcaggactgactttcatcgcagttgcagagtaataagctgactggacatcgatccgttcactgctgttcagattccggtcactgagaccggtgattaccggtgttacgaggatcaggaacttttcatcatcatatggctctgaagtaccaatttttgggatcatggtcatggtggtcggttcggttgccgcataacaaaacccgcatgatgcgatgactgccaggatcagaaatacaatcttccactgttttcgtatcatatatatcacatgattgtctgtgtccccatgggaaatagtaccccgtgtccagttacctcctttgtgatggaaaaaaagaagcctttgagagaaataccggggtgacaacgaggactattacggcagacaaataaaaaactgaactaatcccggtctggtccatgaataatccgcagacaacgggagatatgatcatacccatgctcatgaccatgtttatcgttcccatcgctgccccctgccccacgtccctgccggctatggtgaccagggcatacatggccgggactgatatacctcctccgatccccatgaggagggcaaagaagagatatgaccagaggccttcaaagccaggtaccagagccagtgcaacggttaccgtaagacaccctgttgcaatgagcagatatttatcaaaccgatctgcaagccttccgcatactctctgcaaaagggcagttgacagaactgataccgatattacaaggccggtctctcctgcagagaggttcccgacatgggcggcaatgacggggagaaagaccataaatgttccatttgcaaatgcattcatcatttgatataataatggaatgcgaagccctggatgaatgagcagatgaagtatcgaactctgttcttttcgcgacccctgatacccggggaggaagaagatgcaggtaagcagtgccaccccggttagcgcccccatacaaataaatgctgtatccatgccggcaatatcggttacaatgcccccaagaaaaggccccagacccatgcccagaaagagtgaactggtaaacgtcccaagataccgtccttccattccgggtggagcgatatcaccgatatatgccattgctatggggaacaccatggctgatgcaatcccctgaagaaaccggataccggatagctcaagcactgatccagccgggacatagaggagagaaaaaatcgcatagaggagcagaccgattatgatgaactgacgtctgccacagatatcggagtatcttccgaagaatggcatggcgaaagcccgcgataatgcaaacgaggagaaaatcattccgatcccaaatccggaagcaccaagggtttcggcaaaacggggaagaagcggtatgacaataccaatcccaagcatggtagaaaaaacggccacatagagtgatatgaataataaccggcgatccgtttcggtaatgagaactggatcactcgcaggcataccgtattattacatctgattccataagagagacccttccaccacgatacagcactatgagatcgcttatcatctcctgagactgatatcctgatagatacaacgcagcatggcaggtacagatattcgccaggggtgtggaaaccggtttctcggaattctggtagacctggataacaccctgtatgactttggatatgcaaaggaagaggcatgcaggagagtcgttcaggctatcggagttggaacagcagatgacttagtacggacttttttgttctctccctatggtgttgagagcccgaaagccattcagtcatttttatctgaacagggaatcaccgatgcagatgtgttcatgcgtgcagttcaggtgtacacgaagacaaaaatcgaagcgattgaagcgtaccccggagtatatgaaacattattgaagattcacacggcagggatgaagatcggagcagttaccaatgcaagccatgagcatgcaacagagcggctcatccatatccagaccgctgatcttttcgactgcctggtcactcctgatacggcagggatgaaaaaacctgacccggcaatgtttctccatgctgcagaacttctgaagattcagccccaccagatatgtgcaatcggcgataatctgatcaatgatatcagaccggcaaaagaagcgggaatgtgcaccattcatgcagaatatggaaatcggttgccaccggagtattcagaaggaattattgccgatttttcaatcagttccttttcagatatacttccgatcctgggactttagattcagccgactgtctttccgacaaccgattctaccgcacgtttccagtttgtcatatccttgattgtctgaatatacccgattactcttccggaggtatccgtaataggagaggcttttgcccagacatatgtcccttttccttcatgaaatcccggaacaaacgcttcggtgtaaaaactgttccctacccgtgagacctgtggataaatctggatcaactcttttggtgataagtcaaagaggtcaaccaggatggggagagatggatttgagttcctgattacctcctgatacttgagtgaaccgatcatctcatgtttgttcagaccagtaaggatctccatcgcttcattccaggcaacaaccatacggtcacgggatataatgaaggtggggtcacccatctgatctactgtcccttccagctgctcaaccatgagtgcaagggactcttccatggtccgctgactggtaatgtcaagagccgatatgagagtgcacaggtgaactccggttttatcaaatacccgtgaaaggtggacctgtatcacaagcgaggaaccatcttcccctgtatcagaaaaaacccgggtaaaatttcctttttcattaagtgcagccctgatatccggaatagaactgatgatctggggatagtaacttaaactccactcaatggatcttccgaccatagttccatccgggacacgggagaagatccgcttgaaggaaggattggcatacattaccacatcatccggcgtaatgatagccataccctcataagaatgtgcgattgcagtatccttaatctcaagttcccggaccatcctgacccagtgggtgacgtcatacaggtaggcaatcagacagatgggatttcgatcagggccagtgacccctgatatggttactgagaggtttatctgggatccatcacggcggaccccgtctacttcatatacataccctgatcgatcctcgtgcaacaggttttgagatagaaatgaggcagaagagacatcgatatctttggcaaagtgcttaaaaggcagtccaataacctcatctggagaatgatacccccatagttccagaaatgccctgtttacataggtgatagacccttccatagagaggagtgcaatgggaacgatagaagagtccatggcatgacttttaattaataactcccgttcggcattctttcgttcggtgatgtccctgccaactccctggtactcaagaatgcccccgttatcatcagccagcatccgtgacacccagtgataccacctggaccgcccggaaggaagtttgaattcaaattctgattgaaaaaccggggacaagggggaacaactctgcataccttcttttatctgccgggaagcatccggatgcatgaattcaaataaggagtgttgcagtgcttctgtatgattcatctgaaaaagtctgcaaaatgccccattcgcaaatgaaatgacaccgtcccggttgtaccggcagatgagttcggtctggtcttcaacaattccacgatatctggcttcactgatacgaagccgctcctccatctcagtctcaagggtgacatcttccacgataatggtaaggccggagcgtccgtcgtcaaaaacggttttaatatattttactttaaagaaccgcctccagtcatacttggtgaaggtgacaacagcggtatgctctgtctctaaatctgaatcaaaataggtgtcaaaatgaaatgctcgtaaaatttcctgtggaagcatcagatatgacgtgccagtaattgttgtaacatcctggtcaaacattctgcaaaaccgctcgttaacctggattatcctaccatcacttgaaatgacgagaattccttctttggtaaagcccagaagactggagatgggaacccgttgtgagagataaaataccttggcagcccccatctgctgcatctcaaccgttccggaaatctgaagtatctccagatatttcgcaacagaattccggttacatttcagacgctgggaaatttccgaaattgtgagccctctggggtaaatcttgagtaaaccgcggatacggttcagaaattccccatcctcaaccatagatacatttcctcaatttctccctattaaacatatgccatgcatccctgcaagcatctttttttaaaattgaagagagggagataatattttgttaatattacaaaaaattgccaattatagaatgggataaatgaaaaaatcaaaccaaaacatgtatcagctattcaatgaattctaacatatcggttcgtgtcctactcaaagatgaatccagataataaaagagaagacagatgtccatgcgtcagaagtttccgatgagcggtggttcccttatcagtcgtttcatggtaatactactgattattttaatcctgtccatcctctcgataacaacactctggtatattgatacacgaacccagattgaatcacgcttcacgctccagcaaaaccattctgaacagattcttcggcaatcggtcatatggatcgacgggggcattcgcctgtatgagtactcatttgaaccagggatgaaagaagcgatggatatgtacctggcagcgtataatgaatcaggtggtgatatcacaaagatagacctcccttctttgaaaacacacctgaatgaaacgataggaggtacatgggatctttatattatcgatgctgagggcaccgtcgttcatacgacctatactcctgacctctttttaaatttttgtaattatccttctttttataaaacactcacccgaatcagggaagagggagcttatgtcattgacagaacagtaaagggatttgtcaaagggtccccaaatcggaaatttgcatatcaggggacacctgataaaaaatatgtgcttgaaataagcagaaattttcaaacatttataccaaaagagactgagacatcatatgccgagttagtaaaaaatcttcccagactgaatccaaatatcgtctctattgaacttttcaacacacagggagagattgtaaccagatggagtgcagattccggctatggaaattactctccgcatatccaggaaaaagtcatcagggtactatctgaaaaaaagagtcattattatcacgaacctgatctgaaacaggccatttcaataatatatctctctatccaggataccaggtacccctcatcaccgatgatgaatcttgtcggacggatagtctattcaacccaggagatcgaggaaaaaattcttgaaatttcaataatatacatagccgccctcctttttacccttcttatcgcaggtctcacggtatggaagacatcccgatacttttcatacccggtgaaagggcttattcaggatttaaatcagattgcagacggagacctgaaccatcagatcagagataccggcattctggaactaaaacagattgaaggagccatcaacaggctggtatcaaacctgaaagagatgatcaggacgatacaaacccaggaggaacaggttaaaaacgaactctcaaacaggatccaggcagaagaaaatatcaggaacctcttacaggaagttcagcagaaagaactccagatccagaagagtgaagagaggtaccggagtgttgttgagacacaaaatgagttcatatgcaggtttactccggatgggacacatatcttcgtgaatgatgcatattgcagattttttggaaaaagttgcgatgaaatacttggaacaaaattctctccggaaattccggaagatgaaaggatccagttgaaaaaccatctcgcagggcttaccaggcagcatccgacagacctgaatgaacatcatatcatcctcccaaatggagagagaagatatatccaatggatagaccaggcaattttttcagaaactggtgaaataaccgaataccagtctgtaggtcgtgacctgacagaagtgaaagaacttgagaaaagtctccatgcatctgattctttgtaccgggagacggtcaatgcaatggatgacggggtttttgtcaccgacagtacacactccatcctgatctggaatggatggaaactgggcaaacaggcgaagttactcaaagagcataaacacctggaaggaaaaaaactcttttctattcttacttatctgaccgaaaaagattatcttgaatatgatggtgtcttttcatcagggaagattgcagtatatgagacaatcatagaaaaggaacgaccaatctacctcgaaaccaaaattattccaattattaccgacgatcaggtaactacagttgtcaccctcattcgggatatcacccttcggaaagaatctgaaaaagcacttcataaattgaacctggaccttgaggagattatcaggaaaagaaccgaggatctgcagtcgtcgcttgatgaactggacgcatttgcatacagcgtgtctcatgatctgcgggggcccgttcgtgcaatagacggattttctcatctcctgctcttgaaagcgggggatatcctggatgaagagaacaagcacctgatctccaggatccgcgagagtgtcacaaccatggatagactcatccaggatctgctcaggttttcgcggacagcacgccagccattgcaggtaattgacatagagatgggcgggctggtgcgaggggtaatcacggaactgaccagtcagcctgaaaccagaaatatttcagtccatataaaagacatgcgctcttctaaaggcgatcccggccttatcagacaggtttggtataatctgatatcaaacagtataaaattcactttgccggatactgtccctgatattacgattggttcatatgagaaagaaagtgaaataatttattatatcaaagacaatggcatcggatttgatatgcagtacgcagataaagtctttgaagttttttcaagacttgctccatctccgaatgctgaaggcactggtgtgggccttgcactggtaaagaggatcatcctcaggcaccatggaaggatctgggtacaatctggaaagggcaggggaacaacgttttattttactgtgcaggggagagatggaagcgaaaggtgaaaggagacttgagatacttctcattgaagataaccagaatgatgttgaattatttctgaatgtggttgactggattaatatgggagaccaggtcagagtttttcttgatggtagagaggcacttgatttcctgcatggaaaaggatcatataaagaagctccgggttcacttccatcagtggtcttcattgacctgaaaatgccccttatcagtggtcatgaagtcctgaaagccatcagaaaagacaaacgaacaaaaacacttccaatcgtcgtctttacctcatctgatcaggaagcagatatcggagagacatacaaatcaggagtgaacagttatgttgtcaaaccggttcagttcgagaaatacgctgagaccatcagggacctgataaattactggagaaatgttaatacaccaccaggttcgttcaggcatgatgcataatctgtcactttaaggactattcttttcttatcacttcaaaccggatctttccctcctcaataatccgtgcgacggaccgttcccgtggggaaagagatcctgacccggttttcacttcaacgatgacgatctctttcaggcatccttctgacagaccatcaaagacgataaaatccactggtgatcccaaaaaacgggcatcagacggatgatacgaaaactcagagaaccaggggatcagatgctcggtgatctttcccctgataaccgagtgggatcgtcggatcgcatcctgacgaatcttctgctcttcccatctttgccaatccctgtacctcgcctctgcctgcacatctgcccgtgcatccgcctcttcctgtatccaggtcttccaccttgcatactcatctcttttccatgactcaaagagcatacgggcacgcttgtctgctcttctccagatatgaacgatgattaggagcaatgcaatgatgagcaggaggaaaatgagtgtgacatcaaaagacaagggtaaaagagtgaccggatttatatccatggtatcattgaacagtattatgaagacaataccgattttatggcctgatccagtccgactttattgtatggttttgcaaggacacctgagaagccataatctgcatacgagattattgccgggtctgagagatcaccactagacaccagcactttcacgtcaggatctgattcccgaatgatggatatcacttcgcggccacccatgccaccaggtatggtgagatcaaggatgatcacatcataggggttcccgttctcacggccttttttatattcagccaaagcctcttccccggtgactgcaattgtgggatcataccccagttttttcaggaggattccggtgatttcacagattgccggttcatcatccatgagaagaatgcgatacgccataaatcagaatactcaatggtatggacatctggttataagacatttatgtgttgatatactggattcatcagattcatgcatcatcagaatgaacttatactggtttttgtgtattttcatctttacataactgattcctgtaaccttgtctgccagtactgtcggggaaaaatatttgatacccccgagacggactgcggcgaaattgccatagatgaatcgattcctgctgaagtgacctttcatcttcccgatctctaccggtttctcggagacgatcctgatgcagtcctgacctttatcgggggagaaccgacattacgccccggcctcattcagaccatcatggaagaggcgccggtatcacgattcatgatccagacaaatggcacacttcttcaccgactttctcctgaaattgtcaaccggtttgataccatcctcatctccatcgacggggataagaaaaccaccgatgaagggaggggtgaaggcacatatgaccgggtcatggaaaatattcaccacatcatcgcgggtggatttagaaatgaactcatagcccggatgaccgtgaccgaacggacagatatcaggtctgcggtccgatatcttgcgcataatccgcattactcattctcttcgattcattggcagatagatgcaaacttctggaatgactattcactcagaacctttcagacctgggcaagagattcatatattcccggcattcatcagcttgttcaggactggctttctcgtatcaaagagaccggagaggttccaaagtggtatccattcattgatccgcttgaagacctgctccatggccggcccagcaggttacgatgtggatcggggtatgcaaattacactattctgacagacggacatatcgcaccatgcccaatcatggtcgggatgaaagacttttatgcaggtaccataacgaccgcatctccgaacgctctgccgatcataccagtcacgggtgcctgtgagacctgtgagattcgtgatttttgtggaggaaggtgtctctattcggctattgtaaaaccctggcctaaagagggtgctgatctcgtgtgcgagacagtacggggattatatgatgcgatcaccggtatcgtgccggtaattcgtgagatgataagccggggtgagatcagcattggagccttcgctcatgaaaagtataatggatgcgagattatcccctgaaaagcgcatcccctctttcatgaaaccataccttatgaccaataaatccaaaaggtgtagggtatgaacatatcagtccttgccagcgggagcaagggcaactgtgtatatattgaagggacgtccggggctcttatcatcgatgccggacgatctgcacgcgagatcctgggcacaaaagaccggaagggacggctttttgaggcaggaggaaaccgcgaccttatcgaagggatactcatcacccatgaacatggggaccatgtaaaaggactgggccctcttggaaacgctctgaaagtgtcggcatatgggacgagcgggacccttgatgtaactaaccggatgatacagacaaagaaaaatttcacctttcaatcggtccatccgggtgatcccttctccatcggtgattttaccgtaacagctttttcagtttcgcatgacgcaaccgatccggtcggataccttattgaagaaggggggttgcggatctgctactgcactgataccggagttgtcacgtctggcatgatggagatgataaaaaaatctgacggcgtgatccttgagtcaaatcattgtccgcagatgctcaaagacggaccatacccggcttttctcaaacgcagaattgcatcttcacgggggcatctctcaaatgaggatgcaggaatggtccttgcagaaatttcccggtctatccattgtgccatccttgcccacctatcagaggagaataacgaacctggtcttgccatcagaaaggctcatgaagcattagggcttgcagcagatgatgtggatctctttgctgcatcatcaattgataccaagacgcgacccccacaccgaaaacccaaacagcagtgcagaaggcaatgcctggatgactgctggaagataactatctccctgtaactgacatgaaccatgatatttcttgaatttgcagaattgtgttccaggcttgagaaaatatcaggaagactggagaccatctccattctggcagagacgatatcatctctctctgatgatgatcttcctcatttctgccgccttattctgggaaaaccctttccggaatggagtgggaaaaagctcggtgtcggtccgaatctcctgtatgaagctgttgcctatgttaccggcagaaaacgtgaggaagtcattgaccgtctgagccgggtcggggatgccggtgctgcggttgaagaactcctctcccagaaatcacagacatcttttttcaccgttgaactgactcttgctgacattatggctgcccttatcgagatatccggaatggagggcggacgatcccagaaagaaaaggtccgggttatccagcgaatactctccagtgcctcacctcttgaggggcattacatcactgcaattctcctcgaagattttcggattggggtcggtgaaggaaaccttcgggatgccatcgctcaggccttctcagtcgacccgaaccttgttgagtatgcgaatcaggtcagaaatgacatgggagaagtcgcggtgctggcacgaaagggagaagaagctctccgctcagtccggctggttccgttccatccggtcaggatgatgcttgcacggcagggaacaatatcaggtgtcctaaaagaaggagatccggttgcggttgagttcaagtatgatggggcgaggtttcagttccacaagcagaacaaaacctgcaggatgtactcccgccggcttgaagaggtcaccaatgcgatgcctgatgttgttgcactccttgacgaggctcttcctgatgacattattgtggatggagaggttattgcagttcagggcggccacccaatgccatttcagaccgttctccggaggtttcgaagaaagcacaatgtagccgaggcagcggatgctatcacgatgatcccaaacctctttgacatcctctactacaatcaggagatgcttattgatctgccatttcgcgagagacggaatatactgacacaggttgcatccaggtatgtaacccctcagctcgtatcggatgatgagacagagatagaggcatactaccacaccgcccttgatgctggtcatgagggagtcatgctgaaattacaggggtcacggtacacacccggtgtcaggggaaaagactgggtgaagataaaaccggaggccgataccctggaccttgtggtaaccggtgcagagtggggtgaagggaaacgtgctcatgtttttggatcttttttactttcagtcagagatgatgacagactggttcctataagccgggttgccaccgggttttcagacgaacaactgatctggttgtttgacaccctgcaggatgatattatcaggaaagatgggaaaatggtttattttgaacccaggctggtctttgagatcgggtattcggagattcagaaaagtcccaattacgagggagggtatgctctccggtttccccggtttattgaggtacgagaagataaagacctgaaagaagcaaatacggcagaagatgtcgaggagagatatatacagacacacagttctctaaatacatgataaattcataattctgaagataattcgttgattttggcaaaaaagagagagaaatctttttctgaatttcattttctccgtttaaaacttttcatttaccaaatagatttatcttttcaggtatcgcattcttatacccacggtctctcatgaagagaccaccctacaaccttacaggagggatggcgaatgaatggactacatctaattgctgatatgtaccgctgcacctgcactgctgatctactgtgtgaccagagcaagttagagaaactctgtgtggatgcatgtatgaacgctggtcttaccccgcttggaacatatttccaccagtttatggatgaaaacggaaataaagcaggagtcacgggaaacgtggttttggcagagtcacatctcgccatccacacctggccggaaaataacggggtgacccttgacgtctatgtctgtaactacagcagggataacagtgatcgggccagacagacctttcaggaagtaacatctgcccttgcccccgaagagatggcaagccatgaagtcatcagaggagagatcaacgctgccagagctgcagcaatctgaaatccatggatacatctcttttttcagacctgctctgtgaatcactgaatgataacagcgggtttttctttaaaaagggaagactgctggagcagggtgaaacgccctttcaagtctatgaggtctgggatactccggagcttggaaaactcttccggctggacggatatttcatgacatcagagagggatgagttcttttaccatgagaatatgattcatcccgccctcgtctctcatcctgaaccagagaccgtcctcatcatcggtggcggggatggcggatcagctgacgaggtattcaagcacccgtcggtgaaacggatcgttcttgtcgaactggacaaagcggttattgacctttcacgcaagtactttgaatcggtacaccatggatctcttgatgatccccggatggagattctcattgaagacgggctgaaatatgtcagggagatcggaccaggaaaagaagaaaagtttgatctgatcgttctggacctgaccgatcccctgggtccggctgccgagctctattcaccacgatttatggcagagtgtaaggcacttctgaatgagggaggtatgtttgtcctccacatcggaccgcctgtctatgcaccgcagcgggtatccgggcttatgaaaaaccttaccagtgtctttcacatcgtggccccatactttgtgtatattccgctctatggaagcctctggggtatggcctgtgcatctgataccagagatcccagacagacgaacaaagcgagggtagatgagattatcagggaacgttcactaccaaatcttcagtattataacggggctactcatgaagcaggatttgccctgcctgagtatctgaaaaaaatactttcctcgtaaatttttaaaaagtcagcggtgggtaaagtatgccaccgcaggattgccggctgcatcaatacgtgcaaacccaacccgctcaaactggacaattctatcctgtgttgtgactgcttcaggctcacataccccactgacatccccatcaggagttttcagggtgcaggggtttgcatggttttccggaagccactggatgatcggggcttttttacttctggcttcctgcagatcatcaccggcatactccccccggataatatcaccttcatagagcactttgatattgaagagatccttgagcctgatatatgctgcaccagattcaagttcagcctttggcaggtagagacttccggcaaagggaatctcacggtatcccctcgattcatctcccggatatctcattgcttttgccacaaccgggtcacttccggatacgggaaccagaaccggatcaggaacaaagaagaaccggtcagcctgactgtcaatgatctctttattctttgcgtagaggttttcccatgagaactggatatcagtctccccgataccgatctcaacaaccgcattccgaacagcctgtggctgaataccccggcgtgccatggcacgaagtgttccaagcctgacatcgtcccatccggaatactcacctgactggattccggcccgcatctgggaggttgagaggaccacgccttctatacccatccggccgtaatgccggtataccggagtctcccagcccatatacctgaagatgaactcctgccgttttgtattggcaatatgatccttccccctgataacatgagtcatgcctaggaggtgatcatctaccgccacggagaggttcatgagcgggtatacgatagcatcaacccgctggtgaggagtggacgtgagaacccggaatagcggataatcacgcatggccgggtcaggatgagagaggtcggtctttaacctgaccccaacctctccctcggtaaatgccccgtcaagcatctggtcaaagaggtccagtgcttcttcaggggactgactccggcatggacaggcggtcttgtgcatcttgagatccttaaacttctcattgtcacaccggcagacataggcatgacctttctgaataagctcctttccgacctcataatattttgaaaaccggtctgactggaagatggtttcggcgatggaaagacccatccatgcgatatcctccctgaccatatcataggcatcgggatctacccgttttggatcggtgtcctctatccggaggatatacttcccgccataccgccggatatactcatcattgagaaatgctgcccgtgcatgtccaagatgaagcggccctgagggattgggagcaaaccgcatcacaacccccccttcagcctttggaagatctggaagaccgatcttcttcttctccttcttttcaaagagggaggcatactggtcaggagcaatggttttcagcttctcttcccgatcttcggcagataacgaagaaacctcttccagaactgatcccagtaatccttttatctcaccggcctttgaacgaagttccggatgagttccaagaatggcacccatcactgcccctgcagccggcacactcttatgtttcactgcattggagagagcagcgatgagcaatacagaacgcacgtcgtccatcagtagtcccttttgataaagtaccaggcaagatcagcaagcagtttcttttcggttgtatcaggaaggacagaaagaccattgattgcagaactgatcatatcattcgcttcctgctctacggagtggatcacccctttttcattcagcagggcaatgagggatacgatatcatctttgctcagcgagcgacgccaaggtttgagatcaatccccttctcgcgtgcagtaatggcaatcagagtctgttttccctccctgatgtctgaggcctgatcctttcctgacttttcagaggaggcgaggagatcgatgagatcatcctgaatctggaaggctgcaccgattttgcacccgtaggtatagagtgcatcaacctgtgcttccgaaccccctgcaagaagagaaccaatagctgctgcagcaccatagagcacgcccgtcttcttggtgatcatgtccaggtactcatctcgggtcacatcttcccgctcttcaaaagacatatcctgctgctggccttcgcatatctcctcacaggttcttgcaagaagagatatcgcccggacctttgcaccttccggagcttcagcattacaaattaggaagaatgctcgggcatagagaacatctccagcaagtattgcagcaggctcaccccaaagagtatgtacagtcttctgaccacgccggtacacatccttgtccatgatgtcatcatgaatcagcgtgaagttatgagtcacctcaagggcgaggccggcttgcattatcttctgtgatgccccgggagttacggcatctgctgccagtttgaataatgccggacggagacgttttcctccggcgaataacaggtgatttgctgccctggagagggcagttttcggatctccataacaatcctgcaggagagaattgacctcgtctgctgtttttttcaggtatgtctcaagctccatacgtaatctgttccttatgccagtttctgtctctgaccgtttgccatcaggaagaaatccttgttcagggtgtacccaagttcggttgcaagccccagatactctgaggtaagatcaatcccaccatgagctgatataataaattgcgggtttaagagatgtaccatctcataatgatcctcgcagtatgcatgaccgctcacgtgaagttcatcaaatatcctcgcaccctgtgattttaacatagtaaacatccggtaccgctgggcacgattcatatcattcgggatcagctgggcactgatcatcaccttatcaccccgttctatcttatacggagtgtcattctgggctatcctcgttagaattgaaccaggttctccctggtgaccggtaacgatcggtacatactgttccttacctgatttaatcagccgtcgtagtgttcgctcaaccacccggcggtttccgaatacactggtggtatcagggaacctgaccatcttcatctgttctgcggtgacacagtaccgttccatggaacgtccaaggagcaggggcttacgcccaatctcatgtgcacattcagctatggtctttacccgtgcgatatgtgatgcaaatgtactgacgatgatcgcgttcttgtcatcttcataactggtgataacgtcacggaccatgtttttggcgatctgctcactcggacacctgcctttcttgttcacgttggtggactcggtgatcagacagagcaccccttctttcccaatctttttgagtttggcaaagtccggtggttccccgagtacaggattccggtcaagtttaaagtccagtgcatagacgatagccccttttggtgtatacagggcgaccgttgccgtatcgataatactgtgctgtgtgcggacaaattccattcccagagtatttgagatattgtatcgttgtccacatttcagtgcaatcagtttgttattgactccgaatttcttttcaccctctatctgctgctttaccaattcaatggtatatggagtcccgataataggagcattgtaccggtgaaccagttttggtactgccccaatatggtcaagatgaccatgggagaggataacggccttgaccgtcccttcaagctggttcatgacggtatcatcaggtattacacccatctggataaggtccagtgaatgggtattttccatctctatatcgggatacatcatcagggaatcaagcctgatccccatatcaaatattactatctcctttccgcagcggacggcggtcatatttcgcccaaactcattatacccgcccactgcaaggatctcaatgtccaattctgtctcctcctggaagattttctatcatttcccgtgtcttaccggtgagataccaccgggcctgtggtaactcggatattcgggtttttccggtaaggaacatacttatccggagttcctggtgaatggtccggatagtttcccgtaatacatcagggccttcgcaggcgggttttaagagtggaagtgccattccggcaagatgggcacccattaccagtgccttcgtgatatctattccggatcgaatccccccgcttgctataaccggtcccccgcaccgggttgtttcatacaggctcactacagtcggaagaccccactctccaaaccgctcgcctaatcccttcaggtgcagatcttctttaccggcaacactccccgaccggtggctttcaatgagagcccatgatgagcctccatatccaccaatatccacacatgctgctcctgcaccaaagcaccggatcccggtttcatatgaaatgcccgaaccggtctcctttactattaccggaaccttcaggtccctgcagagttcacgaagagcggcataacatccgcctgcatcatgatctccctccggctgaattgcttcctgaaggaagttgagatgaattgccagggcatctgcatctatcatctcaaccgcacgttctgcccactcaatgccatgatccctgagctgcacaatgcccaggttcccgacaataaacgtatcgggtgctttttccctgacgatagagaacgtatcggccagctcgggattttctattgcagcccgctgggatccgacaccaataccaaggtcaaattcaccggctatctctccaagaaccgcattgacatcttttgtctccggatgtccgccggtcatggcagatataaacaggggagaacccagattatgccctaaaaaccgggtctcaagtgacagacggtccatatcacagtcggggagtgcttcatggactagcctgatatcatcaaagccggtgctgccggattcaatatgttcatcaagacagatacgaaggtgatcaagttttcgggaggaggtaaattccctgcggttcatgctccctccggcaggatcctggtgcccccatgatctgccccgcttaaaaaatcctgaagtcgtgagatatggaatatgtcagattcaataccaatatctgcaagacgaaggagttctgaaatttttccctgcattcctccggtaacgtcaaccgaaccggagccttcaatccttatggtatgcgccattgtccggcgcagttccctcacaactgatccatcagcatccagaagaccgggaacatcggttgcaagcccgatgcgtttcatacccagcttctgtgccaataccctgaccagttgatcaccggaaacaatacatgcccctttctcggtatccatgaccacatctccatgcaaaaccggtacgataccaagatcgatcatgagatgaagatgtgtcaggcagtaaccggagagttctcctccggatgcgaccatgccttcaagcggatggacactaacggcttctattccttcagcacgcaaggttcggacaaccagttcattcagggcagataccgcttgatgtgtcgcataaattccttcccgattctctcgagagacaccactctggatatgatactgcctggcctgtggatgcccgcatgatccggcaccatgaatgagaagaagaggaatatctgcatactctttcagagcccgtgctacctcttgcaggacactctcacgaataactcctgcatcaccccgttccttatcggtgataacacttccgccaagttttaaaatgattcgatcaggcatcccgctcctttctcagtccttcagtatcaatgcaggtgataattgccctgccatcaaacacctcaatggctcctgctattctggccctgatatttttgggtgccagagcgaccatacatcccccacccccggcacccgttatctttgcaccaaacgcaccagttgaacgtgccgcaagaaccagtcgggagagttgaggatggcccacacccagcatctcaagcaggcagtgattcatatccatgagttttccaaggtatgccggttcgtcaagatgcttcatggcatccatgacgatcgcttcgatcgagtccagaaccgggttgatgatcgccgggtgtttcgatttcatttctgcaaccttttcaaccattctgctggtagaatgcgagatctggctgtttcctattaccaggtgatagttctggggagccaggcgctttctcgttccttctttgatgagaaacatgccgccgtacgttgagacggtcgtatcagttgcacttgcccggcctttctggacttttttctctatcttccaggcaagttcggctatctgttccttacttcgccccatatcaaattcatcattaattgctgcgagtgttgccaccgtcactgcagctgatgaaccaaggcctgaagaactcggaagttgtgaattgatatacacactacccttcacaccaaactctcgaaagcactgatcaatatagggtgatttcgcgtgatgtggatgacttgtttttctgacggtaacatatacccgtggtcttattgcaagtgctatccctggcttctcatagagaacagcatgttccccaaataagaatacttttccgggtgcactccacgttgccactatcgcaccgccaatgccgcatagcctacgacctggtcataatcaccacttgtctctcctgaagtggtatattcgagcagatcgcaccgggtcttcccccgggtcctgagtacttccatcatgcatcctataggaccatatccacaggccgtgatgttatgtgactgtattctggaaaaaaattcagggacattcatctgtaaaagtgcctctatcgcatagtgatcatcgcggtatgccttttcggcagagacataatgagagaagtcacttgatgccacaatttttaccggtttttgatatttttccagagcggtaatgattattgacgatatccgatgaacttcctgtaaggtctgatgacccatcatgagcggaacaattctggaccttggaaacctgtactggataaacggcatctgcacttccagggagttctcagagccataactcatcgcccgttcatcaaccgggagatgaatacaggatccaagctcgatatccggctcaagcatcccaagcggggtttcccagggaacctgtgagatacaggtgggaaaaccccggtgactgggacctatgaccagaaatgttccgtcaaacttctcatcaaatgcagcaaatgccttcgctgcagtttttccggagtatacataccctgcatgaggggataccacccctgctgcatcgccggaagatgtcacatttcgaaagagttcagacaggagttgtctgagacgtccgggttcaccaggatagaacatcccggcgactgtactagccctgctcttcatggacgagggattgatcccggttacgtttcaggatatcggttcctgatgatccctgacggaggtatcacatctcggtttcgaagtcttcaggggtcagggaggtgttgtatcccttatgacggaggaactccttggtcaggaggaagtaaatcatggagagtgctttgcgccccttgttattggtcgggacgacgacatccacaagacttgtcatattgttggtatcacaaagggccactacaggaatgctgacctgaatggcttccctgataacctgcaggtcactgaccgggtcagttacgacgacaacatcaggttctgcatagcgtggaagcagcgggtttgtcagagttccaggaatatatctgccgatgatcggggttgcacctatggaatctgcaaaccggcgtgccgggtactggccgtactgacgtgaggtgacaaccagaatttttgccggatcatactgggaaaggaacttcgcggcaagtttaatccgctcgtcggtctcccggatatccagaatgtataatccatctccgcggacgcggtagatgaagttcttcatgtcgctgctcttctgctgggttccgatgtggacacctgctgcaagatactcttcaactgaaacaagaggttcgttcagttcaatctccatttcatttccgttcatagatactctcctcaatccgtatgagttcgtttaatttggctgtccgctccccgccgacaacccccgtttttatgaatatacactgaaatgcgcatccaagatgagcaatggttgtgtcttcagtctcaccagaccggtgacttataactgtttccattccatgacgctttgcaaggtgaatagcttcatgggtatcagtaagagtccctatctgatttggcttgataagcacacaattggcactcccatgagagataccttcctggatacgttttgtgtttgttacaaagaggtcatccccgcagataagacaccggtttcctgcctccctgttcagggcagcaaatccttcgtaatcttcctcatacaggggatcctccacatagatcagatcaaattcatcgatcaggtctgcaatatatgtaacctgatcttcaggtgatctgacggtcccgtcccggtaccggtacattccggattcaggatcatagagctgactggctgctgcatcaatccccggacttatctcaaatcctgtttcatcagaaaccagggatattgcctctgccagaatcctgaacgcttcaggatcagagatcgggggagcccatgccccttcatccccttttcctgcgcgtattccacgttttttcagcaggtcatatacggttttatgaacctgcgcatttgcgaagataccatcacgaacacgctcacagccggttgggacgacaagaaattcctggaactgtgtggcatgggatgcatgagcaccgcctccgatgatattgccaagcggccgcggggcagagtccacaaatattccgccaatatgctgccagagcggaatattcgttgcatctgctgctgcttttgccatggcaagagagagggcaactgcgacatttgctccgattccggagaaattatcagtcccgtcgatctcatggagcagggaatcgacaccgatctgatctgacgaatcaatgccgataagatggggaattacctgcccttgtgcatcagctatagcaagaagcggatcccgtactgcagcttcgtgtatgccggtacttgcaccgcccggcgctgccgctctcccaaatccgtgttcagttctgacctcagcttcaaccgtctttcttcctctggaatcgaggatggttcgcagagttattgcgcgcgtgatggtcatccgattacctatctccgtttcactgttatcggaataacctcacggtcgaattcctccatcgctatctcaagtggatcaatacttgaggtggcaatgaggatcggggcacccatagatatctgaagtgcccgggcgccgacaatccgcgccttctcatagcgagtataagtttgcatgcgtaactcctcaaaaatccgttggcacaagaatggggtcgctgagattcgaactcaggtcagagcgtcccgaacgccctaggatggtccaggctaccctacgacccctcattggtatgggttaagttcgtcaataatctccttgtgcgtgagtaacatacgccggcaacaataccgatccattccgagatcgtcgaggatcctttttggatcctcgctcgcatcccgacggcgtttaaattcctcgtatgcagtggagattacctttccgcaggtgaaacagcgaaccggtatcatctggttgctccactaatgttatagctcatactaataaagctcaccggtatgacttctggaatttcttccgtgccccacgaccatgtggcttctttgcttctttctgacgtgagtcattcacgagcagactgcgatcatacacgtgatatacgtctttcatacggggatcattatgccacttgacaattcccctggccagggctgtacgtgcagcttctgcctgccccatgatacctccgccggccaccttgatggagacatccactccctccagcacacctggaagcagctggagtggttcggatatcttcattctggcaagctcggtggagaacacatcaagcagcagggagttgatacgaactacccctttaccaggccggaatgttgcccgtgcaaccgcggtttttctctttccactggtattgattattctcatcagaggtcacctgatcagtattttgctccaaggaacgtgctgactgcaccaagtgtcacatgtgacgggttacccagccgcttcttgcttgcatcctcaatcgtttcaaatggctgtccggataactcatccgggacaccaacatagattctgatccgcttcatggcctcaattccccgctcacgcttatagggaatcataccacgaatggtacgtttcagaatatggtccggtcttcgtgggaaaaacggaccaccttcgcgagaaccgcgctggcgtttctgcttgtagttgccaagaacccgtgcacggtttcctgatatcactgccttttcagcattaaccactgctatctcttcacctgcaagggcacgctttgcaacattgctggcaagtcttccgagaagcaggccatcaccgtcaattactactaccatgatatctacctacctcagtatccttgtcctgcttcccttcgggttctgggagagcagctgttcaatgctgatgcactgcccctttgcctcagtgatcttgcttactgcagcatctgaaaagctcagtgcagcaactgtcacgcctgcctctacaactccgctcccaagcaccttacccggaacaatcagggtctccccttcctgtgcataccggttaatcttgctgacgtttacttccgcgtagttcttccgcgacttctcaagcctggatgcgatatcgctccagatctcaacttcgttctcacgcgacgtctgcttcaggagtctgatgagttcggcaaggcgcggattggacttatcattccttctggtcatgctccgttaccctctaatttcactcaaagcctcgtgtaattcatctgactgttttttcagaaacagcagtccatgcttgataattctgaccgttggtaatgatccggcactctctacggtgaagaggaatctccggtcatccattccgatatgaatagccggttcatccccgataccgctgttcagacatgcctgctcacacagccggcacaaagaacatgattcaagaccgccatcctttaccccgacagcagaacccttcacttccagaatctcctttgggcagacttcgacacacagaccacatccatcacaccgctcgtcgtgggtgatgatgggatagttcttgtaaccgcataccgtcgtcggggaccattttgcatgttccattccccgctccatgtatgcctgtgcctcgatcacaaccttctggttcttctcaagttttacgatgggaatattgtcttctgccggtcttaccactgcatcctgagagataagatcacctgacatcacaacacccggaccttcaacactcatggtgagcgtgaccgtgcatcgtggacagccggctccattacaggaacactggctgcgggggacaaaactgtcaggatcagtgaccagcgggataagacccagccggtgagtcagaatttcgtcgaagagagcactggtattgtcgtaaatcttgacatcctcaattgcaaaggtcataacttcgctgaccattgcacggcggagtgcatttgcaaacgcgattggggcatcactgagaacaaacgacgcagcgttctcttcaagactgctgaattcgatcttcatcagactctacgaccccttctcccgccttttggcctgattgagtcgtgtggtaccggagttacatcttcgataagtccgatacgcatccctgcacgggcaagtgcacgaattgctgcctgggcacctggtccgggagaacgctgttttccacgacccggggcacggaccttcacatgaagacctacaattcctttttctcgtgctgcctgggcaacattaccggccatctgcattgctgcatatggagaactctcgttccggtcctgcttgacgaccataccacctgaactcttggtaatggtctcagcaccggtcagatctgttaccgtgatgatggtattattaaatgatgcgtagatatgagcgacgccccatttttccttcccttcactcatgattatctcccaacctttgcaatccgctggcgttctgagtgaatatcactgaccagtggtgaagacccggcgtatgagatctcttcctgttcctttgcacttaccgtgtatcctggaatggtaacacggcgtccacctattgcaatatgtccatgagtaatgaactggcgtgcctgctttggtgaacgtgcaaatccacgtcggtagacctgagtctgaagtctccggtcaagctgctgctccaccttgagtgcaagcacatcatcaatatctgcattctctgaaagcattccggaacgctgcagagatccgatcagttcatccttcttccgttcaacacgtgcctgttctgaaccggtagactgcagagcaatgatttcacgagctgctttgcggtacttccggagtgcacccttggcaatccagacttcccgcttgtttctgagaccatactcaataacaaggcgggtctcttcctcaatacgggagagttcgaacggacgcttgggtgtctggtactgtttgtgatttttacctggatagcccatgtttcatcccgcctaggctttctttctcttcacaccgacgataaggccggttcttccggtagacttggtacgctgaccacggactttctggccggtctcatgtctgatgccgcggtatgcacggatcttcttgagcaggttgatgtcatcatcaacagtcatcgtgacatctgctccgagcagatgacgcttgacaccggtatagacgtccttggggcggttactcatccagactggaatccggtcggcataattactgacaacttcacggatccggtcaacagatgcttcatcaagtttacccatcaatacgttcttttcaacacctgcagtttcagcaatgaacttggcagtatgtcgtccgacccctttgataccggtcagggaaataagaacgggcttcgtcccgtcaaggtcggtattatgaaccctgacaaagtagtttatctcctggtcatcctgagccatgcaatgcctcacttcagggaattgcctgcgtgtcagcgttgagggagggatttgaacccccgagtcccaagggacacagggttagcaaccctgcgccatacctggcttggctacctcaacatgcaaaatcgcatcatatcgacactcgcaacagaatctctgctgctacaggaattgtgcttactaatgtggatgggaatgagatataagggttatgattcctgactctcattcccatcgaatcatggatgccctgatcggcggatcccggcggcaagaagggctgatgtgacaagcggaagggcgatggttgcatcacaaaagcactgaactttcctgcaggtacatgactcctttccccatgatacagcctcttcaaaggtacagccggaaagtcctccataatgtggcgtatctgttgtatactggatcgcataatcatgtcccccgcactcgtgatcatgaatggacgcaataacctgcgtctgctggatgaagtttttcggaacccccccgccgacataaatgacaccagtcttctgtgccttttcaacatatccggtcagctgatctgtatcagccagctggtcaatcatgaccagatggcctcctcttcgtgccatgacaagagcaataccaatagacgagtcacacaaggcagggatgaatatggggatattcagacgggctgccgtggcagtaattgatcttccggatggatactcgtgtgaaagccataccccgagcttcctgataaaatctgcagatgagccagaaaaccccacaagtccctctgcaaattctgcaatttttgcatcaacacccctgaactgatcctcatatgcaaaaacatcataaatccggtcaatgccctgtctgaaaaggtcctggtcatccaccatatgatgcccgagataatgcctgatccctgcatgctcacagatatcgtgaaaaatatttgctccggtagagaccagcacatcaataaaccggttttcaagcagggttatcagacattcctgcatacccgcagggaccatggcacctgacaggccggcaaatatggtaacatccggatcctctatcatctgactccataccgcaaccgattcaccaagtttccgcccctgaaacccagtcatactcatctgtttcaggagagaatcaacccgggtttccggctttaccggctgcatggggtgaagattcataccagcggattcgctctgcaggtatttggaaatatcgaaaaagattaaataaaataatgcaaactttcagagatcattcagaacgtttacttattactatgaagtgcgttttatgtgcacgccttggaatatcttcttttcatttcgactattccaagacgttacacaaagcactataacgcccggataagggattcccgggtaacgattccgataactttcccattatctgtgacagggatgctgcttatgttctttgaaagcatctttgacacaacttccgggatcgttgcactcttttcaacactcataaccggagaactcataatatccctgaccagaatattacgtatctgatgttcctggtgccggtcatcaactgcttcacggaatttggtaagagcaacagcaacatcggtctcagagaccagtcctgcgatcttgttgtcagccatgacaatgtatctggcaatcttctcatcaaccatcttccggcggagatgaaccatccgttctccggcctcaattacatggtgaggctcagtgaccgaggagaggtctccttctgggaccatcttagcgagtaagtctccatatgccacctgtccgacaatcttgttgtcttcattgtacacaacagccagttttgcctggttctgaagaagcggaatcaggacgtcgatctcctggtcctcatatacaatggtaaattcggtgtcaatggtattggagacgtggatcgcggttggtgcaacttcagagctgtgtctggcaccaagtttttcaactatcttctgacgggatactgtcccgaccacttcatcgtggtgaagtaccacgaggggatcaagtccggtatcaagcattttatccagggcatcggtgaccggagcagactttgctaccgtaaccggttttgccatcacgtctcgtacaagtatggtattggtcattgaaccacttcccgtattatgtcatctctggtaattattccttttatgccgttcccgccagagattatcacactctgacaggcagtctctaacatgaccgccacggcttctctggttctcgctgtctcaggaagagacgggattatcggcctcatcatccctgctgcggtaccagaccccgcattttcagggttatctacataaaaggcaagatcactttcggtaataatcccgaccgctcctccatcatcaacaacgattactgcccctgctccttttttcatgagatcaaccacatgcaccggggagtgttccggggtgaccattgcaggttcatgcattatctcatggaccggaatatccagttgtgcgaccagatgtgagcgcaaaatgtcagtcctggtcagaatgcccagaaccatcccctgatcaataaccggtgctcccgagatctcatgactgaccaggaggaggagcgcatcacggatgctgctatctggggataaactcaccagatcagtactcatcacctgactcaggggggcactgtccatcttccgataccgccagtctggatcattcttccgcagacgaaacccgatatccttctttgtgatgattcctcgtgcgcgaccttcatcaacaacaagaaccctggatatcttatgcctgagcatcagatttcgtgcatgtgagacggtatcacccggctttgcggcatggaccggtgtagacatcagatctgaaaccagcatcacttatctcctgtcaccattcaccggtgagaacgccctgaccagatcaaactctgtgaccagacccaccagtctgctttgatctatcactggcagagcaccgaccttctttgccatcatggctcgtgctgcatcggtcacggttgcatcaggatcggttgtgaacaggttcccgcttaacagatcacggaccgggatgttcatgacctctgcgacatccccggtgaccagtttttcaaaaactcgtccggtcccgatgtaccgcacgatgtcggttgcagtgattatcccgaataacacatcatttttcacaatgggcagacgtctgaactggtgttctgtcattaccttggtaacagtcgagagcggacagtccggctgttgaaccaggagagagcgggtcataacgctctcaaccggagtagcggcatgtgaccggcacaggatcttcagtacgtcccgctcggtgacgatgccattgagcaccccatattcatcaacaatcggaatgcctccaatacgatcacgaagaatgatatcaagtgcttcattcagcgttgcatcaggatggagggttctgacatcagtcttcatgatcttgctgacactttcattgattgctgcgaggaaattcccatcatgcttgacattgatgagattgaagagctcaccaccgccaagaaaatcaatgacatcccgtgcagtaataattcctttcagccgatgagtccccgggtctactataggcagtctgcgaaatccccattgggtaagggtttcaattgctccaaagatccgcatggtaggcggggctgagatcactttcgaggtagctatcgaaagaacggtcctgttgtcatggtcatgatgtgaattcatgagataccagccttacggttacacagtaaatacgtccggacattctgccgggaatgaacgatcagaaagccggcagatgtcaggattcaggtcaaaaatttatacctccgggtttataggtgcccggattctcaaacattcggatgagattggaatgtgcccgatacaggaacatacagcttctggcagaagaccctgtcagctgctgtacattacaaccggtcgtcttccatacagttcggacagatgagggaaccgtctatactggtcagttcatctgacatctggccgcatctgctacacatccctgaactaatgtcgtcagcacgattaattaccacgagttcgcccattagttcattaatctcggtactcactgcaacgatatcccggacactcacaataccgatcacaacacctttgtcattgatgattggcagtcttctgacccggtttcggatcatcaggtgagcggcatcctcaacggttttatctgtaccaattgtgatcaggggtgaagtcatgatctcactgacatggacttcactcgggcgcagatcccgggcgacaaccttgcagtttatatcctgctcggtaactatccccacggcaacgccatcccgaaggacaatacaactgcctgatggatccttgctgcacattttccgtgctgcatgcgctaccgttgcatgataatcaatagtcttggggttcgttcgcattatttcccgcactgggaccttggtctcgagctggatcgtgtcactgttgtagctcattactgtcacctctcggtttcccgggcagatgcattgctctgatacttatcgggatcgggtattaatccatcgctccggtgaccggtatgtcaaatatgaagatccgagacaggtgggatgacaacaataataatactccctgatcataaccatgtagacaggcaggcttttcacaggcctgatttcaaaaaaacaagcccagggacgtaaccacaatgggaataagccagactctctcgcgaatcctttcaaatcttttccagaacaagaccgcccgtataggtatttatggccctccaaatgcagggaaaaccacccttgcaaacaggatcgctgaagactggtcaggcacggtatccggaacagccagtgaggtgccacatgagaccagacgggcagtcaggacaggaaatatcaccatcacaggctcaaacggccggtctatcacgattgatatcgtcgatacacccggtgttaccaccagggttgattataaggagtttatcgagtacggcattgagcgggaggatgccatcacccgtgcacgcgaggctaccgaaggcgtcgcagaggccatgcactggcttcgtgaagatattgacggggttatttacatgattgacgcgaccttggacccgtttgcacaggtaaatatcatgatgatcgggattattgaaagcagaaaactgccggtgatcattgcagcaaacaagattgaccttcctgatgcggcaccccaccggatacgcacggccttcccccagcaccccgtcataccggtttcgtgtcttgatggtacccagattgaaaatctctatgaagaaatggtccggcatttcaggtgaaaaacatgcagggtgtacgaatagatctcatatcagaagaacggctcgcacagatgccttcaatggaaaagatacgacttatcctggataatgtccgtgatggcaccatcgtcattcttgaaagcggcctcacacccgatgaacaatccgtacttattgagatgaccatgcaggagattctgcctgaccggttttcaggaattgagattgagacctatccttccaagcagcgatccgcaggtgtgttctccaggtttatcaggggagatgaagagaaccggagacttaccgttatcggtcctgcaaatcaactcaagatgatacgaaaagatcgtggtcttatcagcgcctggatatcagggaggtgaaccatgcctcatcgctgcgccggatgcaagaccctgtttcctgatgcacgccacctcagggacggctgcccggtatgtggctgtggcaagtttgtctttgagaccggcagaaagagagcacaaaaaaatgaacccctgcaaaaccatgcacctgaaacaccggctcctgcacctgtaaccacgaccagagagcacacagacgttgaactagaagaaccgaagcaggattctgattccattgaaagtatcagaattctcgaacccggcagatatgacctgaacctgtccagactgatcgaaactgatgaccgggtcgtacgggttggatccgaagatacgtaccatcttgatttacactcgatgatacggcagaaaaagaaaaaataacttcttttgctgtttaagagatattatccacggtgtatccctttgtagcaagaagatcgataacccgatcacggtggttaccctgtaattctatggagttgcctttcacagtaccgccacaggcaagtttacttttcataaactttgaaaggtcttcaaggtcaatgtcagtcggatccagcccctcaatgactgtgacttcttttccataccgacgtttattgactttcacattaattcgctgctgttcctttgcaacttcttcacagatacagagttcttttggtagcccacatatggagcagataccaccattcattacttattccatctcatgttttactattaaatgcttatcataaaatatcccgatataaaccggttttttctcatccatggatggaggcggttgttgcattatattatcttcatccatcctacctgagcatatatgtctgtcatggtcctggggaccgcttcacatgtagggaaaagtacgatggtagccggtctgtgccggatcctccgacgccgggggatttcaaatgccccatttaaatcacaaaacatgagtctgaactcctgggtaacggaggatgggggcgagatcgggatagcacaggcgatgcaggcacatgcggcaggcattccaccctgtgtggagatgaacccgatcctcctcaaaccaaaaggggatcagacatcgcagatagtgctgcttggcagacctcaccatgatgtacatgcctgcgactactacaaagtgaccgacaacctgctgaccattgcattagaggcggcaggaaaactcatgagtcggtacggggcgctcgtcgttgagggagcaggaggcgctgctgaagtaaatctctttgaccgtgacatcgcaaatatcggtcttgcccgggcactcaaattcccgattatccttgtcgctgatattgaacggggaggtgtgtttgcacaggtgtatggaacgatctcccttcttccggacgatatccgcccgctggtaaaggcagttattgtcaataagttcaggggagatcctgcccttttctcagatgggatgagaatccttgaggaaattaccggcgttcctgcaatcggtcttgttccagtgaccgatgtggatatcccaagtgaagactcgctctcattgcaggataaaaaaaccaaaagtgctcctgttgagattgcggtcatccatctgccccggatatccaacttcaccgactatgaggtacttgagcggtatgcatcggtcaggtatgtaaaaccgggaactccgctctccgggtttgatgccatcattctgcctggaacaaaaaacaccatcgaggacctggaagaggtgattgcatccggaacaggtgaggagattaaaaaggccaggactcagggagttccgatcatcggtatctgtggcgggtaccagatgctctgtgaagagattcttgattcgggtattgagtcaaaagaggggacgtttcatggcctgggccttatcccctgcaggacgacattttccgggtatgagaagacgacggtgcaggtgacccgtacgtcatccggtcacgggccgtttctggagaagattgcgtccgtatcagggtatgagatccacatgggaaccacctgccggggagatatcagggaagcattttcaggagaaggagttgtcagtgaagacgggttgcttatcgggacgtatatgcatgggcttttcacctcaccacatgtcgctgctgcatttgtcaccttcctctgcgaccgcaagggactcacatggaccccgccagcgcaggacaaggatccgtttgataccctcgcagatcacatcgaggctcatgtcaggatagaagagatacttcccttttttaactgataatattcatgatgcttcgaaaaccctcggatcctgcatcatcacagaccacgctggtgaccgttttcaggtcaacctcaacagttccccggttcatggtgcaaaaggcacgagcgggggatgggacttctcttccggggataccaaaccgtaccgagtgaacgcaaaaccggcacttctcaacatcttcccgtttatctggaaggcaggccaccgttcccttctcaaccgggagggttcgtatcgctctcatgactcttcaccagggagcatcaaatccatctcttcttcggtgaattcagagaattttttcctgagctcttccaggatcgatctctgtttttctttcagggaggagagacgctcttttctcttctcctcttcctggttcagttcatcaatcctcttttctgcttccgtaatagtctgggtgatatgatttttctgttcaaggagaacgttcccttcaagatcctgtttctttcttttcagatcttctgaaagtgtgtgcagacttatggatatctcaccgaatttttttgtatactcttcagcgttcgtaaaaagatgtttctcaaacgagttctttgcctgtacgattcctgactcaaacagagtaaagaggggctttgccgtcagggatatcagccgtgcaatctcatcgtcatcgcgccggggtgatgatgcagcctggatgagatcctccatgttcttctcatccaccggttttgcctgttcctggaaggctttgactccccgtttccacaccggaagagcaactcggatctgggactcccatgtttccctggctttttccaactgctccctgatctgtccggtctcctcttcaaggcgcagatatgaggcataggaatctgaagcaagcagacgttccagctctgaacccgccttctggagatctgtcttcaattcagataaccgtgcttcaaattttttctcttctgcacctgcctgcgcctcctcttctatcagggcatcccggttgtggagaagggcacgcatttctgcaatgtgcatgagccgttctcgcgaaatccgtatgatctcggtcatccggttcagttcatggcccatatggtccaacgtttgtttaaagaccttgacttcatccggatagagatggtggagatacctgcccggcccccggtacgccttgaaacacccgttgataagtccggcgacttcccggtaaaagacctcatcatcctcggagaactccccctcaagttcagcctctatctttttacagaactgggggagtgcatgacggttgacctgttccaccttgtggtgatgtggctcgtctgatgattcttcaccaaactctgtcagaagctggtgaagatcctgttcaagtttcagtaatcgttcacgtgaactcgtggatgcggcattccgacgggagatacagcccgcttccatctcatcaagccaggcagggagatcttcaagtgatatcgctgatcttggtgctttttcagatgttttgctgaatattttttttattgattcaaacataacccatctccttatcgtccggggcagtccccgtcatcctggttcagtgccctgatacgtgatattccgtctatctcctgaatcaccctgacaacggcaggaggaacaaaatcctcccagggcttgtcacaggcaatcaggtccctgatcttcgttcctgataatgtcgcccgctcatacatggcagggctgaggacctcaatcccggcctcgtgaaagagccggataacaagcggatttcctgagtagatccggtggaatggtggcgtcatggcacggacatgtgacacccataatacattgcggtttatatcctcaagcgggatgacatacaggggtttgtgcaggtcctgcagggcaccggtgatcataagcacccgttctccggcggtaaagggatctgcaggctcatggctcatctgggcactgccaataccgatgatgagttcatccgcttcttgtgcgatctggtttatcacataatgatgcccgttgtgatacggctgaaacctgcctatatacagcgcccggatcatgatcccgccaccaggtttgcgatcatcgcagcagaggctccggcgacaaaccctgcatcaatatttaccaccgtcaggaccgaacaggactggagcatgctggctagggcagcctgacctgcgcccatgtacccgtacccggttgagaccggcaccccgatgaccgggcgatccacaagaccggccaccacagatggcagggttccttcccttcccgctgcaacgacgaaggcatgacacccctccatctcccggatgacggggaagagacgatgaatgccggcaacaccgacatcatatgcccttcgaacttcacaccccatctcttcggctattatcctggcctcctcggcaacccgtatatctgacgtgccggcggtgatgatcccgacaactcccccggtcttcggagctggtgtccccttcgccaggaccagaacgcgcccttcatccgaccatgcagatgatatatcctcactccgtgcccattccatgagtgagacggcagtttcagggtcaagacgggatatgatacatcttccggcggatgtgacataacgttcaataatcgaacggagatgagctggctcttttccttctgcaaggatcacttcagggataccgcaccgggccttcctggacatgtcaaggcatgccaccgagccgaccggtagaactgattcagcacatatctgtgccagcgcctcgtctggactcaatgtgtggtcatatgccgcctgcagaatatgtttcagatccggtcctttctccatatggaataagtacgatatgcaagaaacagtacataataggttcattgcgatgagtattctctttctgatatcagtctttggtgtgcttgtctgcatcttcctctggctgcgtgatatccggatctgggcacggtccctgcttcccgggtacaggaaagcctcaatacacggagtataccagactgcgcttgcaaccactggtgcaggtatcgtttacctgtggccggaggtctccatcctggggaccggggttgtcctgcttggactgtaccttcagggaaaagaggagagagagaagatctggacagacgaaccggcaataaccaggttcttcgggagtgttccccggaataataccagaaggtaacatcatgattcaaaaaccacgcgggacacgggatatgctccctgatgagatggagcggcgtcgtgagatagaagcacggatgcgggcacgggcacgactctatggttttcgggagatagcaaccccggtatttgaagaactggagctcttcaccatccggtcaggagaggggatcatcaatgagatgtacgtgtttgaggacaagggtggcaggtcgcttgcactcaggccggaactgaccgcaccggttctccggatgtatgttgaagaggggagatcgctcaacaaacccgtcaaatggtgctattttgccgactgtttcagatatgagcgaccacaaaagggaagataccgccagttctggcagttcggggcagaacttatcggggcagactctgccatgggggatgcggaggttatcacactcggatatgaccttctcaggacggcaggagtaacgtttgtcctccgcatcggccatctctccttcatgcgtaccctccttgcagatcttgccgatggagataaaaagaagatccgggcatttcttgacaagcgtgaggaagaagccgcaataacatacctccgcgatatcggacgggacgacctgtgtgatcccctcatccggctgtgtggtgcccggacgcttgaagatgtttttgcaatcattggagagattccggaggctgcacgggttcgggagatgtttgccatcctcgacgcatcgggtatcccgtacgagataaacccggcgattgcacggggtcttgattattacaccggagtggtctttgaatgctttgccgaggggctgggtgccgaaaaccagatccttggtggtggtgcataccgtcttgcccatctctttggtggagaagatactccatcggccggatttgccatcggttttgaccgggtaatggttgcccttggtgaagcgagctgggtcccctggcagccacaggtgatgatcataaccacgaacgaaggacgggactatgctctcaccattgccgggcagttcaggatgaatggcatcatcaccgagactgacctgatggaccggagcttctcagctcagatgaaggctgcagggaagagtgcagactatgcggtcatcatcggaaaggatgaggttgaaaccgggaccattacccttaaagacctgaaggccggaacccaggagaagatcacagctgatgaggcaatacagaaactgacatccgcttaatatggcatcaccaaaacctgctcatgcagatgaccttgcgaaacaacagcgtagcataagtgttgccgaattttttgagaagaacaaacatcttctcggttttgactccccgacccgtggcattgtcacgacggtgaaagaagcgattgataatgcacttgatgcctgtgaagaggccggagtccttcctgatatctatcttggcatcttccagatggagggtgatatcttcaaggttgtcgtggaggacaacggaccgggtatcgttccggagaatattccctatgtctttggaaaactcctctatggttcacggtttcaccagatcaggcagtcacgtggacagcagggtatcgggatatccgccgccgtcctctatgcccaactgacaagtggcagaccaacccttgtcatctcccggtgcggatctgatcgtccggcgttccggttcctggtccagatcaaaaccgagacaaatgaaccggagatcctgaaacgggaagagaccacctgggaccgggtgcacgggaccagaatagagatagagtttaaaagctccctcaccgccaggaagaggttgatcgaatacctgcgatatacttcggtggtcaacccccatgcccgtatcagggtggagatagatggagaagcaatcctctttgaccgggccagtgacgaaccgatcatccctccgcaggccatactcccccatccgcacggggtggaacttggagaactcaaacgtattgcagccggttccaaagagccacttgaaccatttctcatcaatagtttctccagagtcggtcagaagactgctcatgagatcatccagctggcagggctgaaagagacgacgaaagccaataaactggatgccgatggtcttgcacgtctgcagtcagcaatgcagcaggtaaaagtcccgcccccgcctgcaaaccagtgtctctcaccaatcggggaagttcttatcaggcagggtcttgaaaaagagttccagtttgacttctgttctgcacggacacgaccggcaagcgtataccatggtcacccgttcatcgtcgaggctgcccttggatatggaggtaaactggacgctgaaggaaatgcccggatcatgcggtttgcaaaccgggttccccttatgtaccagcagggtgcctgcgccatcaccggatgcatcagtgcggtaaactggcggacctataatatcagccagtcagggctcccaaccgggccggtccttatcctggttcatgttgcctcaaccaatgttccctttaccagtgaaagtaaggatgccatagcgtccataccggagattgaacgggagattacccttgcactgcaagaactcgggcgggatctcaagaccttcctctcacgaagggacaaaagcaggctctcagaagagcgtgcccgggcaatctgtgccatcatacccgagattgcaacaaaggttgctgagaccatcgaaaagccggtccctgatatcaccccgattgaaggtcagatcatgcgacggctggttacaaagaaatggaccgataatgggaccgtgaacgtatctattcagaactatacctcccatgcccttgatctgaccctctatctcataaccccggatgatgtcagcaccgcagatccccctgctgtctttgttgaagagatgggaacagataagtccgcggtctggcagatgcggcttgccggtggggaaaactggcagctcaggtataccgggaccggaaatggcatgattgacatcaggggtgttgatgaaaagaagaaagtggtggtagatcttgaccggtcataaggagagcatcagggagcataccctcaaacgactacttgccatcccggaaaagtggtacgagcagatgaccaggggcgaactcccctccatcaccatgccgacccggacaaaacgaaacatcgcctatgatgaagaggccgaggtatggaagtacggcgaccgggaacggcttcgggaggctggaacagagaagagtgccctacacatcctcaagatggcatatgtcatctggtttttaaaacatcagataacagaaaaccggtcatcaacactcagagagttatattacatatcagaaggctggaagcgggcaaagtttgctgcacaaaacgactcaaatctgttggtggaagaccttgagatcctgaccgatgtccagcgtgagcactttcacctgcgccctgaagaggacggtgcaagtatctttggtccgctcagaatccgggaagacacaagacgaggcaccagagaactgcactgccaggatgatatcggagagtcaggataccagataccgaccaatgttgattccctcgaatttgtcgagcatgatgcacagatggttatagccatcgagaccggtggtatgtatgcccgtctcatcgagaacggatttgacgagaagtaccaggccatccttgtacacctgaaaggacaaccggcacgatcaacccggagagtcctcaaccggctggccagtgagtttcagcttccggtcacagtatttaccgatggtgatccctggtcataccgaatctttgcaagtgttgcctatggggcgattaaaagtgctcatatatcagagattctcgtcaccccgtccgcccggttcatcggggtgcagccatcagatatcagggattatgaccttccgtcagacttgctgaccgagcaggatatcgcagcactcaaagccgaattaaccgatccccggtttgcaggtgactattggaaagaacaaataaaccttcagcttgcattaaacctgaagtcagagcagcaagcatttgcagcacggggccttgattttgtgacggatgaatacctgccggcaagactatctgacatgggtgtattacggaaataatccgctacaatcactatcactatatcctttttcctcctgatcatgagtatggatgctttctcactccccgcgataatgctcccccttctcatcaacgctagtatcctgctaatcaccctcctctatggatgccgggaggatatcagagagcgggcagttccggtggtgatgtggtacccggcggctgctgttggtacattgatgctgatatggttctggtactcggtcattacatcaggtgatctcccctatatgatgccgcttattcccctgatcctcttctttgtcatcgcattctatctctttacgagatttcatctcatggggatggcagataccaaggcactcatcctgatcacggtcctggtcccctgtttcccgttcgttcccctcaccggctatccgctctttggttttcccccctatgtcttctttcccttcactgtactctttaatgccgtcgtcctgaacctgcttttgccggtggccttcttcatttcaaacctcataaaagggaacaaagccccccttccctacctcttcctgggttacccggtcaaaggtgagaccatagcagatgagttcggcatcgtcatggaacactttgaagagacggacggaactcttcagcggtcattcattccggtcagagcagcaatcaaagacatgttggccggaggaaagcgggtgtatacaaaatcccttaaagaaaacccaactcaataccggaaagaactcgatctctataagaaagccgggaccgtgtggatcagttatggagttccgttcctcattcccatcactgcagggtttctcaccgcgatgatctttggtgactttttaatggctctcctcaccctgatcgcgtcgtaggatacctaaaaaaccacatttataaagacttgggcagccttttcatgatatcactgatctgatgattcccatcaccagaaaagagatatcagatcgcgtttttgagccagataaggtatataataaaaggaatgaatgaccaattataacccggtgaaaatatttgaaaatagttcctgataccagcgtcgtcatagacggacgcatcaccaatctaattgataccggagaatataacggagcccatataataataccggaagcagtcgttgctgaacttgaggcccaggcaaaccagggaagagaaataggtttctcgggcctgacagaacttcaggagctctgcaaacttgccgaacaggggataatatcgatagaatttgttggtgtccgccccacccttgagcaggtaaaacttgccagcggcggtgaaattgatgcacttatccggaaagttgccatcgattacggagccaggtttatcacgagtgatgtagtccagtctgaggtcgcaaaggcaaaaggcattgatgtactgtatctcaagccacaggtggaagactttactccgcttgccatagaccagttttttgatgaacataccatcgccgtttacctgaaagaacgggcaaagccggttgcacgaaaaggaaccatccagaagaccgagacgatgaccctgcgtgaccagctctgcacggagtacgaactgcgaatgatcgcccaggagatccttgaacgggcaaaacgtgacccggacggatttatcgagattgaaaagcggggagttacggttgtccagataggatccatgcggatatcaattaccagacgtcccttctctgacgggatggagattaccgcagtcaggccgatcgttgacctctcactggatgattattccgaagcagatctcataaagcagatgcttcggggagaaaagccggggattcttatcaccggaccaccaggatgtggaaagaccacccttgcccaggctattgcaacctacctctgtgatgaaggggttatcatcaaaaccatggaacagccacgggagatgcttgttccagaccagatcacccagtatactgcccttgacgggagtatggccaataccgcggacgtactcctcctggtcaggcctgattttgtcatctttgatgaacttcgcagaaacgaggactttgaagtatttgccgacatgcgacttgccggcatcggaatgatcggaatcatccatgccgtgtcaccccatgaggcactccagcgatttgcggaccggcttgacttctctgtccttgcacagatctttggcagcatgatctatgtcagggatgggcagatacaccagatctgctcaaccgccttctctatgaaggtcccggagggcattgactctgatatgcagataagacccgtcacgacggtttcagatgtaaagacgaaccttccaatctttgagatattcagatatggcacggagacaattgttcttccggttgaggagggagaagaaccagaaaactccgagaagtatgtaccccctgaagagaccgtcatgcatgcagagcagcgggaggaaccagtagaggagaagccatctgatgacgaagagccggacgaggaagaggaggataccaatgcctggtccatcaccgaacgggacatccagcgggagataggccgatacaccggtggcgaggtcactgttgagatgctctctgctacaaaggcagttgtctatatcgatgaccgggatgttccggcagctataggaaaaggcggaaagaacatcgctgcaatcgtcaacaaggtcggcgtcggcattgacatcagaccatcatcagaacttgcaaagaaagtaaaggccctctcaccaggatcaccagaccgggaggaactgacccttggtgacgggctgcaggtcagaatagacaaaaaacaactttccatcatctctccggataacaccgggaagattgtggatgtctttgccggacgggagtatctctttaccgccacggtgaatgactctggtgagatccacctggcgaaaaacagcaccatcgcccaggagatgctgcgcagatataatgagggcgaacccatcaggctcaaaacagtgtgagggtgtgaatgacggaagagacacaggctttggaagctgctattcggaaacaatgggacggggtgtttattgccaccccctctgaaaaaaagaaattctatctgaccgttgcctacccgtacccgagtggggccatgcatgtcggtcatggccggacctacatcgttcctgatgttgtcgcccggttctggcggatgcgtggacgggaggtcctctatccgatggcatttcatgtcaccggtgcaccagttatcggcatctcaaaacgtattgccaggcgtgatgagagtgccataaaactgtaccgggatctgtaccgggttccggaggatgtccttgaaacgtttaccgacccgttaaacattgtcaaccatttttcaaatgagtatgaacgggtcatgacccaggcaggtctttcgatcgactggtcacgacggtttaccacggttgaacccacctacagtaagtttatcgaatggcaatggtaccatctccgggaagcaggccatgtaaacaagggtgcccatccggtcaggtactgtccgcagtgtgaaaatcccgtcggagaccatgaccttcttgagggagacaaggctgagatccagaagtttaccctcatcatgttccagtacggggatgcattcatcccctgtgcaaccctcaggccagagacaatctatggagttaccaatctctgggtcaatcccacggtcgagtatgtcagagcacgggttgacggaaaggagtggatcctctcaagacaggcgatggagaagattgccctgcaggatcatgaggtcgccgagataggcaccattccaggatctgatctggtagaaaaaaaagtcagtcaccccttctgtggggaggttcccatccttcccgcagtctttgttgatcctgatatggcaaccgggcttgtgatgagtgttccggctcatgcaccctatgattatatcgctcttcgggacctgcagcggaaaggtcagtatactgatatcaaaccggtcgggctcatcacagttgaggggtatggagaatttcccgcggtagaagcagtcgaaaaggctgatatcatcaaccaggatgatccaaaccttgtcgaactgacccagtctgtctatactgccgagcatgcaaccggaaagatgtacgaacagtatggtggaaaaccggtcaaaatagccagagaggagattgcaggggttctgatcgagaagcatcactcaggcattatgtacgagtttgacatacggccggttgtctgccggtgcggatcacgggtctttgtcaaagtactccataatcaatggttccttgaatacagtgatgaagcctggaaacagcaggtcaaagaccatcttgaaaacatggagctcgtcccccaggaggtcagggcagagtttttccggaccgttgactggctcaaggactgggcctgttcccggcgtattggtcttgggacaaagatgccatgggatcccgagtggcttatcgaaccgctctctgactcgaccatctacatggcctattataccatagcctccaggattaagcacattgatcctgctctcctgacaccggcggtctttgactacatcttccttggaaaagagtctgaaggacttccggagcgggaacgcctcgatggtatgagaaaggagttcctgtactggtacccgtatgacttcagattctctgcaaaagatctcatctcaaaccacctgaccttccagctcttccaccactgcacgatattcccgaaagaatgtctcccccatggtatggttgtctttggaatgggcctcttaaacggggcgaagatgtcctcgtccaaggggaatgtatacctgcttgaggatgcaatcaatgactttggtgccgataccgtcaggatgttcctgataggttcaggtgaaccatggcaggactttgactggagaaatgaactggtctcatccacgaagaaacagattgaacggttcgcacagaccatcagggacggacttgcagcagatggcccggagacggatattgacaggtggcttgtctcccggatgcagaaccatatctctttggtcactacagcgatggagaacttccagaccaggcaggcacttcaggaggctttcttcggatttgaatcagacctgaaatggtataaacgccgtcttggtcagaatcctgcagggaagagtgcaatgaagtcgctctgttcgacatgggtcaggctccttgctcctatcatcccgttcacctgcgaggatctctggaaggagatcggggaaggccttgtctcattcgcaccctggcctgaatcagatgcttctcttgttgatgatgccgcagagattgctgaggaacttttagtcagaacggttgaggacatcgaatccatccttagaattctgaagacaccgcccagaaaagttaccatctgtgttgctccgtcctggaaatgggagattatgacgcttatagccggagcaccagacaagaagaacgtcatcagggatgttatgcagaacgaggagatcaagtcacgaggtaaggaagcagcagatgctgtcaaacaatgcacaaatctcttccacaaacttccgtccgaccttgtggaccggattatcgcaaataagcctgatgagttggcagtctttaaggcagcatcggcgttccttgctgaagatacaaaactcgagatagaagtaatacccgccgatgcctgtcagcatatgaaggcaggatcagcccttcccttcaaaccggcaataataattgagtagattttattctactgattttgcttttttaacccgttccttggtggagtacccggtcacatcatccagatatctgcggaaccgcttgttcgtatcaaggatgacctgctcatcttcaattccctgctttgaaactgttgcgatgatgattgatttttttgcatctcccagttttacctgcatggattcaagggcgccatatgagatcgtgaaccacccgtctttctctacaggagcggcgccaaaatgttcggttatcttcgcggtaatattctcgggaagaaccttgatgtgagttcgcttaaccggatattcctgcataaatgtactcaatagttgtgtgatcggatatgtgttacagatgagagaaccatgtatataaaaacccaaaaccagtatactcaatcagatacccggaccgattgttcaacctcccccttatcctgacatcccccgcaaacacgttccagaaactcctgcgatactctccctacctttatttataccatcagtctgcagtactgatcacgtttattctggtggggatgatccatgatttcagcatatattaccacacaggacggtctgattccggtagactcgtgggaggatgggtgctggatcaaggtggtcaaccccacagaaaaggaaatatcccttcttgttgagaagtttggtgtctggattgagttcttcaccgacccccttgatgttgatgaacgggcacgtttcgaggtggacgaaggaaatattctgattcttatcaggtcgccacggcgtgaacctgaagaggcagcaataccctacataactctcccgattggtatcatcctgactgcgaatgttatcatcaccgtcaccctgaccgaggtagatgttcttgatgagttcctctccggatgggtcagaaattttgataccaggacaagaaccaggtttgcgcttcagatctgttaccggacagcccttcggttccttcggtacctgaaagatatcaaccggatgtcaagccagattgagatgaacctgcaccggtcaacaaccaatgacctgctccttgatctctttaacctgcacaaaagcctcgtttttttcacaacatcgctccggtccaactcactgatggttgagaagttctcctattcaagtatccttgatatgagtgacgaggagcatgatctctatgaggagatggtgattgagaataaacaggctcttgagatggcgaatatctatacctcgatcatcatgggtatgaccgggacctttgcatcgattatcaataataatgtcaatgtcgtgatgaaactcctcaccagtattacaatactgatttctttgcctacccttattgcgagcatttatgggatgaatgtaacacttcccctgcaggatgatccctttgcgtttttatttatcatgttttgtgcattagcggccagtgctataggattatttgttctggtcagatggaaagttttatgagatttatgtaaaaaaatcaggaaaccaaaccgacctgtaaacctacctcatcaatgaacatgattcacaagagaaattattagaagaataaatggttgtattatggcccccgatttgattcaaaccaccattgatcttccaaaatcgtttccatggctcgtcaatatcagaccagatgaggtcggagtatatattcaaagagcagtagcggtagaactatttcgtgaggaaaaaatttctttggggaaagcagcagagattgctggttttgaaaccaaaatggatatgatagatgaactcataagtcggaatatcggccttgattcttctctggaagaagctgaagaagacctgaatactcttaaacaaattcttcacaataacattgttgtttgattactactcgttttccgatgcgataaggaaaccattacaaagtttttcacctgataccttttttctctttatgcgtttttttggatcatctccttgagttagatttatctcacacaagttggatatatctaacataatgtgagaaatatctcaccgtgatattatgaaccggaccgccatcatcacactggaaattaccatagcagccttggcaattgtcgttctcatcggaacgtacctggcatcaggatttacgtatgatgcacttatctggatcctcctgattgctcttgggattggagctatgtatctactgaaaaaacacaattccccagaggttcggcgcatcatcgcaatcatgggtgttctgtgcattgggatatcattcgccggattccttacccccacacccctcctgcctgcaacaccaaccatggggatggtttttggtatggtcctcctacttttacactggaggatgaaaaggcaggatggtgaccttggtctgcaggatgaacgatcactccgcatcgggacatatggtatcgcttgttcctggtacctgacctatatcgtggtaatcctccttgccaccgcgattagtcttggaggtatgcaggttccggcagagtcagtcatcctcattctcataatcctcatgcccatcagcaccatcctctttcagacctactataaccacaagggtgatgtctactaggggggagccgtgtacacccggataaaggaattcagggtgagacaggggataacccaggctgatcttgcccggaaagcaggcgtcagacgggagaccattgtttttcttgaaaaaggaaaatataatccatccctccggctggcccatcatatcgcctgcattctgaataccagcatcgaagaactattcttctttgatgatgaaacaggaccggatgaataacccataacaggtcataaaacctacaacataagaagaaactatgataatggaaatcttaaccaacccccgtgcttttttcagcaccatttgtaaattggaaccatctctgaagattcccgcccttatcatccttgtgatggcactagtcggatcgattaccgggtatatgatgggagaactctcagggaaactgttctctggaatgatggaagggcttgcaacaatcgctgcagtcagtgctgcaatatcaacattcttttcatcctttatcatctggctggttgcagcagtgatcctctttggactgcagaaggtcatgcagggtaccgggacattcaagcgggtcatggagatctgtggctatggaatggttcctctcgtctttgcaaccatcatcacacttctcctgagcggatattatatccctcaggcagatatcagccccatccggtcaaccaatccggaagagatcagccaggcagcaatgtccatgatgctggacccggctcttcatgaattcagcatcatctcaaccatcgtcaccatcatcttcctcatctgggtagcaaatatctggtcaatcggcgtagagacctgctgtgggcttccggcaaaaaaagccctcatcgtcgcaggacttccgatactcatctatgctgcctacaccctcgcaagcctcctgctcttcaccgggggaccggtatgagagcagagacaataatcatcctgttttttgttagtctccttctcgtatccatcagtaccgcagaacttctcccggagaatgaagcagcagcagcacagatacaggtgatcaacctctccattgacccggctgttctcatgccctatgacaccgcaacggtaaccattacgcttgcaaataccgggacgaagagtgtggccatatccagtgcacagatgctctccaaagagttcaaagtactgtctgacagttatgggaaagtaggtgccattggtgccggaaacacgatgagttttacctacacgctccaggccgggggggcacccggtatattttaccccatcttctcggtggatttcagggatgcaaactttctccggtatccgttcagggttctggtccaggataatccccttgaggtatcggttctgaataagccggagacctttgtatcaggaaagaaagaagatctgaccattcatgtcgggaatccccgtgataatcaggtcaccggtgttacggtgataccacaggcaggggaacatgagataacaccgacatcatacttctccggcgtccttgctgcggacagttcggtagatatccccttctcggtaacgccatacggagattcaccgattgtatttattgtccagtatcagaatggcataaaccagcatgaggtctcatacacgttaccggtcgagaccggaaagaagagcagaaaacaggcagataccgtcctttcaaatgtgcaggttgataccaaaaaggattattaccgggtgactggcgatgttacaaactccgggcttgaaacagcaaatgcagtcgtgataacctccgcagagccagcggtcccggtatttccgttcaaggtctatgccgttggtgcactcaaacctgatgactttgcaagttttgaagtgaccttcagggcagatggaaatgtcaccgaagtaccgctccggacatcctttaaggataatgacgggaatgagttctcttcagataccctggtcgaactcggggaaagaaccggtcccaaaccaaaacaggataaagaaggattttcaccggttatcatcggtggtcttgtggtgattgcactgggagtgattggtgctatctggtacagcagaagaccacggggataagatggatacacagccggtgatcgtctttactgatgtcaccaagatttacccccttgatgcaggagatgtggtggcccttgaccatctctcacttgaaattcaacgcggggagtttattgccattatgggcccttcagggtcaggaaaatcaaccctgctcaatatgatcgggtgtcttgacattccaacgtcaggtgacgtgatcatcgatggaaagaacatccggaccatgaccgatgaccagctgacggagcttcgccgtgatgttctgggatttatcttccagcagttcaacctgattctcctcctcaatgcacttgaaaatgtccagtacccgcttattctcaagaccggagagaccggatgcacagaccggtgtaaggaagtcctggctgctgtcggtcttacgtctgatctctggcaccaccggcccgggcaactctccggcggacaacagcagcgggtagccattgcacgtgcccttgtcaatgatccggagatcatgctctgtgatgagccgaccgggaatctggacacgaagacggggaccgcgattatgcagcttctcacaagactctgcagagaacagggaaagacgatcgtcatggtcacgcatgatccccggacggcagagtatgcagaccggatcatcatgattgaagacgggaggattacggaggacgcatgagtagtcaccgactctttttcggtcttgcggtccgaaacctgcagatccactggctcaggtcacttcttgccgccattgggatcatcatcggggtggttgccatctcttccatgggcatccttggaaacagcctggttttatccgtgtcagactcgcttaccgatgtcggtgactcggtcgtggtgacacctcatgtctcatttcaggggatggccagcaccgggaccgacaagcgtataactgatcggcaattggaacagatacgccgtgcttcggggaataacgaggtggtacccgtgtatgctggaggagaccgcatcaggattggccgtgagattcttgccgcatccatctacggggttgatccgcaggatattccgactcttctgaatattgagtccggccagttcctccggggagcatcgggagtgatggtcggggcaaaattagccaaagagaataaccttgccgtcggctccaggattctggtcggtgatgaggaggccggagtcagagtagtcggaatactggcagagcgggggatgggatttgatatcagccctgattacgcaatcatcgcatcagatcagtggtacaaggactgttatgatgtcaccggatatgaccaggtcatcgtgaaggtcaggaacctgaaagatattgatcaggtcaaggattcaatagatgcacaactaaaccggcgggagaccgaggtgaatgtctatgataccaaggcgatccttgagaccattttggaaacatttggcaggatatccacctttaccatggcaatcggagggatctccctcatcgttgcaggagtgtccatctttaatgtcatgatgatgtctgtcatggagcggtaccgggagatcggaatcctccggtctatcgggacaaaacgggccgaggttaggagcatgttcatctatgaggccctgatcctcggggtatcaggctcaattatcggtggtgtgctgagttttcttggtggatatgcagcaatagccatcatgctccaggagacatcatacctttttgcattctccagccttatccagataccctatggcatgatttttggtgttgcaaccagcatcctgtcaggattgtacccggcatggaaagcatcagatctgcggccgattgacgcactcagacatgagtaacgagaaaaatagattcaaacctgatgttcttcaggttcctttgatcttttcggtttccattcatccttgtggacgagcagggcatcaagaatctcctggactccttcaccactcccggtggacatggatgggtattcaggaatgcttgtgagatccgccttgtttgcgacaaccacaatcggtacctgaacaaggccttttacttcctcaaggagccttaattgttcttccagaggatagccgcaatgggcacttgggtcaaggataaagaggagggcatccgcaatattcacaattgccgataatgcctgccgttcgatggcatttcgctcaataccaggccgatccaggacaccgggcgtatcaatgagctgaaccttctcatgtcggtggtaataatggccgacgatgattccttttgtagtaaagggataagaggcaacttcaggctctgctgaggagacccttcggataaatgatgatttcccgacatttgggaatccggcaaccacgatggtaaaaacatcctcaacggtaggcagttttcgaagaacattccggacatcattcaaaaacaggaggtcatcttcaatctggtgaactacggatgagagacgggcgattgccttttttcgtgctgcaattgagttctcttctgaagagtacctgacatcctttgcaagaccgccccggtgatccttggaccatcgggcagcccagccgacagcacccagggattttttcagccgatcagtggtccagagaatttcaacaatatcctggtaaaactggggctcttcagataacgtaggaaaggactggatgactgaaaccagtttatcatggaccgagaggtaggcagcttcaacaaactcaacactcgctctttttttatttggtttctcccgcatcttttttgcagcacgacgaagtgcccggtcaagcacttcatctgctgtgggaacggtagggattttttcaaaactcacgatatttcacccgtatgtatacgcgtacaggtatatactaactcccctctgcatatgccaccacagaattaggagccttcaaacaaagagcgatgcaataaaatcagaacgcagctctggattatgaacaggtactaaaactatgccctgcagatcctgatgccctgatgaacagaggtcgtgctctcatagaactaacccgttttgaagaggcaatcagtacatttgaacaagttattcagaataatcagaaccatgcagcagcctggatatcgaaaggttttgccctcttcgaatcaggaaaatatcaggaagcattggaagcatttgagcagggaggcctgataaatcctgatgatccggggatctgggaacagcagggagatatactcatcgaactgggcagatttgaagaggctctgtcagccttcgaaaaggcaatacagatgcggcctggaaaaggatatttgtggagaaagaaaggccatgctctcaaagctcttggaagaaaggataagatgaatgaagcatatgacaaaggattccgccttgactgccctgaatatgatatctgaacctttgtgactatggaaaaatgaagagaagatcccgttatcaagacatacccttcatctcatgaattcatataacagcccaaacccggatgacaaaaatctttttccactttttactcttttacaacaaactcagcatcttcaggttctaatggaatgagaatccaggcgatcaggtaaatcagtatgccggatccaaccgtgagtaacaggacgatgaagataagtctgatgatgatcgggtcgatatcaagatattttccgatacctccacatattcctgcgaggatcttatcttttctggaccggtacaaccgttttggttccatgctcacttctctttcctcaaaataaataatccttgtgcgaaggagagaagaactcagtttatccgagttactaatacaaaatctacacaaaggatcgcaacggtaatcaacagaaaaacagcataccgcatttgaaataagatggatctaaaatgaacagtatggacgcgaccccattattgaagtagaaataactctgaaaagttcttaataattctttatttgttcgtaacacccgaacagaaccatcatgatttatcatgtagatacacgcaataaaatctgatagacctgatcagccggtcttgggacatatcccatcgggacagatatttgtaccgctctccaactaaaatgtgacaagatacggcatacatgagcatataaccatggatttatctccgattcaaaacgacatcctgattacgcttatcagcctgtatgaaaaaaaatctctccccattaaaggagaggagatagccgacatcatcttacgcaatccgggtacggtccgaaaccagatgcaggcactcaaggcaatcggacttgttgatggtatccctggcccaaaaggcgggtaccacccgacatcacttgcatacaaggagttacatctgaaacatgacggtgaagcatatgaggtgaagatctcccgcgatggcgagattgttcctggtgtaaaggtcggggagatcatctttaccaccctctctcatgccgatatctgtcatgcccagattcggatcatcggcagcgtgaaactcttcaataatggcgatatcatcaccatcggaccaaccccggtcaataaacttcttataaagggcgaagtcttcgggaaggatgagaacgaacctgcattgattgtatcaatccttgagatggtgtcgttaccgaaaaaacccatcagggactacatgacaacgcccatcaagatgctctcgaccaaaaataccctgaaagaagcgatcagactctttaatacccaccatatccatggagccccggttatggacggaggatttctccgtggcatcgtaaccatgtctgacatccttcatgccattgagcaggacctgcccctggacacccgggtctgtgaggtcatgaccgaagacgtggtctatgccgatgcatcagtccagctgtatgaagttatcagaaagttcaaggagcgttcaatcgggaggctcgtggtttttgaagagaaccggccggtaggtattctgacacagtctgacatcttccggacactaccgaccaactaaccggggatatatgcgttcatttacgacatctcatggcattttttacaatggcgactgcataaaaggggcagcgctcattcctgacaacactgttgatctcatcatcaccgatcccccgtacgggattgaaggggacaaactccaccggcactataaccgggacgaatcatttgtcaccgacggatatgtggagatcccggcggaggagtacgaatcattcaccagagactggattttacaggccgaacgaatcctccggccaggtggttctctttatatcgtctccggatatacccaccttcgacatattctcaatgctctctatgaaaccagccttgaagaggtaaaccatatcatctggcgatataatttcggggtatttaccagcctgaagtatgtctcatcacattaccatatcctcttttatgcaaagcccggggggaagcggacctttaacaccgaatgcaggttctccctctctgaaaaggatgagaacgggggatcgcttaattaccaggatcgcgaggatgtctggatcatcaaccgggagtataaaccagggaaagtaaagaataaaaatgaactcccgaccgctcttttaagtaagatcatccagtatagcagcaatgagggtgatctcgtgtgtgatctcttccttggggggttctcaaccgcaaagactgcaatcggactcctgcggagagcaaccgggtttgaaatctcaccggtcatgtatgatgcgaagattgatgagatgatggcagtagtccccggatttcttcttgataccgcacagaccccgaaagaacccagcaggaaacgaacccggaaagcctggaatccggaagagacagagcagcttcggaaaagatataacgaattgaaccagaccagcctttcacagaaagaagtaaaccagcaattacaagaggaatttgatcgggggtactggtcgatagaaaaagccctcaaacagaccggtataaaacccggacgataaccggagacatcggtatctgatcgggagatttattattggatacgaccgaaatctgatatatgaagtccatacttgcccgcacgctctcacggaaacagatcgtgaccaatgacgggaaagcaatcggatcacttcgcaatctgatggtagattttgatacaggcctgatcacagaccttgtgctagagcctgatcagtcctttgatacaaccggatataccctggacggagaccggatgcttatccctttcgaagccgtcagggacataaaagactttattgtggtagatcgttaccttgccagaatgtgaggaaagtacatcctcattatctcaacaaagccttcgccgtacggaactgatgagcaataatcagagatattccgtacatcttcctgagcatttgcaacgcagcagccggttcctgcagccttaatcatcccgatatcattctccgagtctccaatgccaaggaactcatcaggctttatacccagctgctctgcaacgatgtgaaatgttcttcctttatcaataccggcctcgtgaatatggatggcaaagttagtgtccatgatatctaccggccagcctgaaagaagggatctgacctcttcaaccggtacctcacgggcaaacgcaatatccgaataccgctcctggtgggagtagagctcaagacggatgccttttttcccatagtattcttccagcaggttcagcgcctttaccgcaatatcccggtttgccataacctgcatggaaccctgaaacccgatccggtacacaccgccattctcgccgatgaaggttccgccggtgccaatgagtttgcatagccccttgagaagacaggaggtgttgcctgatgagagcaccacctctataccaccctcctgaagctttcgtattgtctctatggcagcagtcgaaagtctgcgcttttcatcagtcagtgttccatcgatatcggttatcactccccgtaacacagatgcactcctattatactcctataattgtggacctagcaggaccgaagaccgccctcttccaccaggaacgttgcttccccttccggcaggttcggactgtcaaccagccggaagatacgctttccgcccttgctttttcgcaggtatacccggaaggtggcggtatggccgacgatatttcctccgataggttttgtcgggtcaccaaagaaaactgccggattggactggacctggttggtcacgaggcctatagcattgtactcgtcgcagagcttgaagatgtcatgcatatgacgattcagtttctgctggcgttctgcaagggtgccacgacctgcatattctgatctgaaaaggccggtgagtgagtccacgatcacgagtttgaccggctttcctgcagcttttagttcctctgctagctcacgggatgtctcgatgaggagcatctggtgatcagatgtctgggcacgggcaacgtggatattctttaagaattcctgtggatctgcaccctctatctcaagacccttcaccatctgctcaatacgttcaggtctgaaggtattttccgtatccacgtagatgaccgaaccgttcaaaccgccaagttcctccgggagctggacgttcactgccatctggtgaacaatctgggatttcccagaaccaaactcaccgtacatctcggtgatagcctgggtctcaaatcctccgccaaggagttcgtctacctccggaacaagggtccgcagcttcttgaccttcagacgctgctcaaagacatcagtaccggtcttgaatcccccgatatctgcctggtcccggcaccacttgatcatcttctttgcagttgcctctcctagttcagccgcctctgcaagggttgcaggaagggatgttgctatgctttcaacggtaagaaatccagcatcccgtaacttttctgcaattgccgggccgacgcccggaatatcctcaatatccagtctccgctgttgcatatgtgtcgaatcttccttctgtgcggacgaagcatcagtggaaccttctgcaccagggtttatctgggatgtacaccacttgatcatcttgcgggcggttgcttccccgatctctgcagtatcatagagttcggttgcagttgcctgtgcaatcttttccactgactcatacccggcttcacggagcttttctgcagtggttggtccgacaccgggaatgtcctcaagtttgtatgtttctgctgccatagtagtttcctcatcatacaggtggcagcgaggggtatttaagtctaaaataaacggggtgaaagtgaaaatggcatttatgaaaacgaccgtatgaaggaggaaaccgcattcttcaacccttcaaggtcttcttttaccacctcttcactttcgcagaagaccctttttccactcgcccgaccggtcataatgacatgtgacccatgggggagacgggtctccaccagccatgatccctcccggtttgtaatgactatcccctccggtacatgcagtatccatccttcaatcctgaccggctcttccttatcgggaataacggtgagagcgccccctctccctagagagacctcaatttcaccggatcttccaacttttgtataggcattatagagtatgatcgtctcaccggggaggagcgttcgttttgcctcaacatcccaaagaaccagagggacatcggcagttccatcagaaaaccggaggttacggacaaaggacgttgttccatcccgcttggtaaagggttttgccggcaggatctttgttattgtgccccggacagtacagctcgtttcaggagcgatatgatcaagcgctgttaccgggatatctggggatgtatctgcctgggcgatgaaggtctcttcatcacacacaatctcccgtcctccatagtctccctccttcgtcagggcaccggtcaccgatacagccatccccggagatattccagataacagggcaggctcccagcagataaaccgtgcagtcccgtttgtatcaccgacaagaccactcaccatctcgccgctggtaccatcccggcgggtaaagggacggggctcggcaagactgatgacgagaaggtgcaggtctgtgcgctcaggggccttccgctctttcacctccatcacacaatcgatgtccacacaggttttccgcaaattcagcggcataatctcccggatggattttccatgccggccgatgatctcgaccacgtcgcctatctcaaaggtctcttcaagggctgcagcctgctcatcccagaagaccagttcaacctgtccggtctcgtctgccaccgtcagtcgtgcaaccaaacccttctccccctcagggcggtcaaactccctgacaccagagaaggcaatgatctttgcataaaaacagaagagggaggacttcccccgcagacctcgaatcttgacatgggaccggccaagatcttttactaccagcagggctgccgtggtctcatctgcgaggtttccacagtcagctatcttcttctctatcagacggtcgaactcttccctgctgatcaggtcgtcgaccagggcatagtgatacctgaccaccggttcactccggcattatctgagccatgaaggggtctcgaggtttgccatcagatcatcaatggtctctgcccttcgcatcagttctgcctgtcccttcctgaccagcacctctgcacaccggcccctcccattatactgggatgccatcgagtacccataggctccggcgtcaaggacggcgataaggtcacctgcaacgacaccgggaagcttccgatcatgagcaaggatatctccggtctcacagataggcccggtgaccgtgtaggtccctgccggctcttcatcagcacggtttgccacgagcacctcatggtaggagtcatacatggccggacggatgagaagattaaaccctgcatccacgttcacaaaggtcttgtgtgccttcttaaccgagttcacttttgttagaagaacggttgagtcacagaccatggaccggcctggttcaatccagatctcaggctgaataccgagccgtctaaggactgacgtgcagaccggcataacggcattggcatagctggcaaaggttggtgcatcagggccgaaatgatcatacgcaaccccaaggccaccgccaaggtccacgaatttaaacctcacacccatccggtggagttcctcgacaacctccatcatgacctgtgcctcctttgcaaagggttcaacgtcaaggatctgtgagccgatatgacagtggataccgaccgggacaacgttcttacaggcaagggctgctgcatacgcatcggtaatctctgctgccggaatgccgaatttcgatgttgcaaggccggttgctatcttcgggtgtgtcgggacatctattgccggatttaccctgaaggatacctcaacaacctttcctgcttcacctgcgatccggtcaagctgggccagctcatccagtgagtcaagggatacccggacacccttctcgactgccagccggtgatctgcctcggtcttggatgaaccgttaaagagcaggtgttccggtttcatcccggcaagaagggccatgtgcagttctccggatgagaagacgtctgctcctgcaccctcctgggctaggatctttataatattgaggtttccatttgcctttgcagcatagagcacccggatatgcgggtaatgatctgacagggcagatacatatccccggtagttatcccgaatccttgtttcatcggtgacatacaggggagttccgtacttgaatgccagttcaaccgtgtcacacccatcgatcatcaggtgctgatttttgatggaaagatgagggggaagattcaccatttcacctcgcccatccgttctactgcctcttttatccggtcaactgagcgggtgattgcaaacctgacataaccttcaccggattttccaaacccgacaccaggggttacgacaataccggtctcgtccagcatccgtgctgcaaaggagatactgtcaggaacactcatccagacataaaaagttgcctttggtgtcgtgacatcaaacccgagttttttaagtccgctcaccagaacatcccggcgttcctggtagattttgcatgcctctgcaacacagtcctgcggaccttccaaggctgcaatggctgcatactgaaccggattaaagaccccggaatcgatgttggtcttgacaataccaaggccacggataacctccttgtttccaaccgccataccaatccgccatccggtcatgttgtaggtctttgacagggagtgcatctcaattccgacctcctctgctccgtcagtctcaaggaaagagggggccttgtatccgtcaaaagagatctcagagtaggcattgtcactgacgacgacgataccatgttcccgtgcaaactcgacaacctcctggtagaatgacgggggagcaatggcagatgtggggttgttcgggtagtttatccacatcagttttgattttttagcaatattatttgggatggcgtcaagatcagggagaaacccgttctctttgaggagcggcatctcatacgtctttgcttcggcaaagagtgctccggtactatagaccggatatccggggcttggaaccaggacataatctcccggaccgacgagtgcttcagggatatgggcaaccccatcctttgaacctatgagggatatgacctgtgagtcaggatcaacatctacaccaaaccgtttattataccagcctgcaaccgcctgccgatatgccgccatccccaggtacgaagggtagtgatgattatcagggttttttgcggcatcaatgagagcatcgacgatatggggcggagttgcaagatccgggtctccgactccaagatcgatgacgtcaaccccttcagcccttttctttgctttcatctcgtctatacgggcgaatagataggggggaagattcgctattcgttgtgcaaacatggtggtacacgttagccaccagaattcatagatgtttaggagacgaaaaaagacgagagggatcagaccttaaactggttcatctcctcatggatacgcttcaccgtctcatgggcctgatcagtaaccgcatggatctcttccatggaagagtttacctgggagaccatgtgggtaatctgatccacagctgcagatgactcttcactggcagcggcaagtccgatagactcttttgcggtctgggtcaccatgtcactgaattcattgacggttgccgtgacttcttctacagaagcggcctgctcctcactggcagcagcgacctcgctcatattggagttgattaccgagatggaagtcacgatctcattaaagatattgagagtttcattgacagcaacatttccgctctcaatctcggtcagggacttctttaccgctgcatccatggcccctgattttttctgaagtccggatatgatgcctgcaatatgttctgcagacttttgggattcgtttgccagttccttaacttcagatgccacaacagcaaacccaagaccggcttctccggcccgtgcagcctcgattgcagcgttgagggccaggaggttggtctcttctgcaatggaactgatgatatccacgatacggcctatctcctccatctgctggctgatctcctggttcatctcattgattgcagaagatgcctgcataatatccttcatcccgctctctgcctcaccggctgctttcttcccattttcagagagttctgctgcggtgttcgtaagtacagacacctgttccatctttgctgcaactgatgagacggtggtggcaaggtcctgcatggcagcaagaatctgctgggtgttcatgccactcttatctgcaagatcattgacggcggatgcaatccgtgcaacctggctgactccatcagatacatcttcgatgcttttgtgagccatgccggtctcatgggtgacgatattcaccttctccgtgatctcattgacttgcccggacatgatatccatatgatcccggacggcggacagcgcacgggagagatccacgccgatggtgttcagggcatccctgaattcaatgaattccccttccagatgtatatccggattcatccgtgcctggaagtccccggaagcatatcttccacacagacgcatagcttcctgcagtggaacgaccatggcatcaactgtctcgttcaccccgtcaataataaccgcataatctccctggaacttactgacatcccccctgacattcaggtttccggccgatgcggcagaactcagcgccctgacctcatccctgaagagctggaaggttgataccacctctgcaaaggcctttcctaatacagatatttcatccctgctctgtgattcggcaatgctcaccgagagatccccatgctggacccgatgggcaacctggaccagttcatccattctgcgggatattgaccggccaaaggcaacagataccagagtgccggcaatgataccaagaatgacgaccagaatgatagtgtttcggatggtatcgagtggaccggtaaaatcggagaggtcgctgctggcaacaatgatccagtcaaatggctcaaaataatcatatgcagcgatcttttgtgtgccctgccagggatattcctgataccctgtcttttctgcaattattttcttgacaaagtcatacgaggtcatatcctgaccttcaagagaggggtgaaggaggagttttccggtgctgtccaggatatacatgtacccatgttcaccgatcttcttctcccggatctgatcctgtaaaagcccgatagtattggcctcttcaactcccacaaagaggataccgatgatatctcctgaagcgtcctttatgggttcataggcggtaatatacttctttccgacaacatttgcagtcccataataggtctgccctttgttaatgaccgcatcatacaccgcatcagagacgggtgtaccgactgcccgctttccatcctcaccgatgacattggttgagatacgaattgcctgatttcctttcttctggaataccgttgcagctccgccaagaagctcctgaacctcatcaactatctcaaaattattattcacgcgatacgaagaaccaaggatgagctccccattcacgatggaaggttttcctttttcgtaaaagagctggcgaagaacattgagatcactgttcaccttgacctgtgtcaggtcatagaccgtcttcgtctcttcagtgatatccgcggtctgcatctcaagactcatccggatatcattcttaatcgtgacttcagcactactatatgcgacatacccgagggtgatcgtcggaacgatgaccagtattaggcagataagaatgatcttctgccctatcgtagcattgtcaagccagtgtcttactttcattaccatgtattccccttcctgtacacaagcagcaagcagcctaagatttacactgccattattatactgacaatatggtgcaggttatatttatcatatagtatattttcctccagggattttcaaaaaccacatcagatctgaacccggtattgatacatccagaaatactctacagatcagaacaaaggccggactgctttttgcgcttctggtgagagatacccgtatacagcaccggcaacgacctgaagccatgcaaggatatcctccctccttctgcccgttatagcacagtacttctcaagatagagttcttcaaatccctgaccggagatggaataatccatgtaactccgacatgcatcagcagccggatccccacaggagacttcagcccagtcgataatcatacatgattccccctcacagaggatattccccccgtggaaatcaccatgacagaggaaattaccgtcagggagtgaatcaagaatcttaagaagtttttctttctcatcaggggtcagacccggacttgccccaatcattctcttctgcatcactttcaacggcaaaaaccctgaaaactctactttatgtaacgcggcctgaagcttgacaacggtatccatgcactccggtattctattccgatcttcaagcatgacgtctaaaagagagattcccctaacctgatccataagcaggaccgtccggttacagaaggtctcaaccccatagaccttgggagcggggatattgagttcattgatgaccgccatggtgtatgcttccagaaaagcctgatgtgggggttgattttcccgaaatacctttgccgcgattccatttcgtgcatagatgactgcagccataccgacaccgatctgatcaccataccggtcacggaacgctttatcatctccaacagccccgaaaagggaggtaatgttgatttcatctgtcataataatcctcatttcataaccatgcccaacatcagaagagacaggcgtgtgatatgaaatacttttttgtaactcggtttataatattcgatccgctcacaggggtagtgggatcgttctcagcatggatgccagatgtatcatgagaaacccgagtatgaagagattcgcaagaactactattgacgggataattcctgggaggatcaggttcatcccaaatccgatggtcagaaggtgcaggattatgacgatccaaagcagttttttcttactctttgacagggagacctgcgtattcggagaggagcgatgcgattgcagaaccggaatgactatctttgtaagaccggtgctcccggtgagaagattccagaatcccaggattaagagcatccggccgcccaataatccggggacgatgcaggagtacataccaagaagggcgatgaggattccgatacagatcaggaaccaggaacgtttgtatacaccaaagggagtttttccaagggccagtacctgaactgccatgatgaccataagcaggccaaactggccgtcacgggagaacaggtaataccccttaccagatggaatgagaataatcgcacattcaatgaaaataatcccgagaagaaggatgaatgagaccggtacagaaagggaggcttcatggtgcaggagaaaccagacaatacctgatgtgcccttatcctccgatgtttctggatctcgttctttcatggggtattgcagtgatagtgtctggatacaccatgcgagatagaaaagaccggcactcatgaccagcatgaggagaccggtaaagatatctggcagaaacctggggaagagaaccacaaagccgaataaaatcactgtcaggtatacaaacccacatgcaacggtcaggtgctgtaatacacccggaattctgatccactgtcttgcccttccttcagagaagaggagattaaaaaagagcataactccgccggatatcatgatgcacccgaccagttgagggattattccggccagaaatcctggaataaaacaggcaccggttccgataatggcggttgagaatcccaggatgatgactatccaggtacggcggaaggtcccgaacggagttttcccaagcgttatcatctgaattgagagcaggacaaggagtaatccaaaggtgctgtccggattaaaggggaggagtccggcctgaatcaggaacatgagcaggccgaagaggagcatgaatatgccaaagacgatcaggatcacggttgcaagggtcagatcagatgggttgtccagcaccggaccttgcaggttattcagaggaggaggcgggagggtaggtgctcctgtttgttcgtttcgttctttggtaaacatagttttggaatagatagtatttttccgttcccttctttcaccagatggccggaatgcctggaaagagggatgagatttcaggtcagatgggccccgatgccataatgtttctgtaaaaatctcatagttttttctgattctgcccatcttttatcgagattggtaataatattatcgatatcctgaacacaggcgataacagactcttcgatctctggtgcatgcatctcaacaagtgaggaaattaccgtgagcgggtttctgattttgtcattcagcagggccagttctacaaggttgtgttctaactggagaagaagtctttttctttcttcttccattttcttctggttagtaatatctatagcaaccccgatagccccggttatcgaatctgtaacatcccgcagcggggaggtgaacagcacatacctccggtttttatatgaaacttccatggttgtgacaattcccataagagcctgggaatacgcttcaaggaatgcattatcagcctgatgaaagacctccccgattttttgtccgactctctcatttgaactcagccccaggttgatcagaccttctccatagatgcttttcaccaccatgttggtatcagttgtcaccacaatacctgggatatgatccacaatcatgcgaagtttcttctcattttcaaaaagtgtctgttcctgaatgatgagtttgtcataattctgcctgagctcttcttcaacagagagaatctcttcatatgctgttccaagttcctcatttttacgtatgagttcttgttctgccagctttctctccgtgatgtcagtcacatacacacgggcagtccgatacacctttgtgatatagatatattcatggaaaaatctcccggagattgttatttcccgatgaaatgatatctcatctccgtttttaacagcgttgagaatctcatcaagacctccgggaatgaagagagaaatatccgcagtattggtaagttttcgaataaccgaagttgtcgctgtattatgaaaggtaatgttgccatccccattcatttcaaagataggattcggatttaattcaatgaaagatgcaagggaccagatcttctcttcatatgcaagaatatctgtgatatccagggggattgtaagcatgtatggccggtgattaatggtgatcattacgccggagataagaatatcttttactttcttatccttccccctcattttcaccggaatcatgctgaaagacccgtcttttttcatcaaatcaacgatgttttgtctctgattcagatctacccagaaatcaagatcgattgcactctttccaatcacttcatcccttgtatacccccagtgatctgtaaattgcttatttacttcaaaaaactggccgttggttagatcactaatagcaatgccttccggtgcgagattgaaaattgttttaaataatccctcttcatcttctaaagttgcagtggtttgaatatttttggaaatatctgatattatccagattcttcccattatttcatcatttttgcctagaagagattttgtttccagccatttatctcctgtaagacatgagaatttttgagagaactcaagatgcggattatctttgatcctttctaccagttcaaggaacgactctggttcgatattcaggtcaataaattttggcaataattcaataagatgattattaaggtaactatcatccagatggaacatctcccggaatgattgattaaaaaacaataataagagatttggatcggttatgacgatgccattcggcagagcctcatatccagtcaggaacagatcacaactgtgcgacaatgcaaccatgtatcaatatactcaatttttcttagttcttatatcagtttatttttatgccactgtaaagtgtcccatcccggttgctattcgttgaattgctagagttgcttctgaaattgccctggatatctgatctattgaggcggttacttcttctgttgctgcagcagaatccaccgcttcttttgcggtttgccgaaccatgttttcaatctcattgacaattgcggttatctcctgcactgttgcagcctgttcctctgaggcactggctccttctgccagttgttcataaatgagattaatagcggctacaatctcattaaacactcgtaatgtctccctgactgcctcgttccctgatttcacctcatgcagtgattttgtcatggaatctgaaacgatctgtgactttttctggaggtttcctataatagtggcaatattttctgctgacttttgtgactcctgtgcaagtgatttgacctcatcagctacgactgcaaatcccaatccggcttctccagcccgggctgcttcaatggccgcattcagtgcgagaagaccggtctgctctgaaatcccggtgataatgcctactatctttcctatctcttccatctggttattgatgtcctgtatattgctccccgtatcttcaaatgagaccatgattccattcattcctcgctcggcttctcctgcaagtttcagccctttttctgataactgcacagtctccatggcttttcctgatgcctcctctgcagcagcggcaacagctccgactgcttttgagagatcatccatggccgagaggacctgagtaatactcctgctgctccgctctgcaagcccgcttaccgatgaggagttctgtgcaagcatagtggttgtactggagacctcggttgcactggcattggtctcttccatcaacgcctgtaatgtctcaacctctcccttaacgccgttgattgcgtcagatacactcattccactgttatccagggcaatcttgaatttttcaaagtcacccttcacctgcgccttcgtatcatatcgggcggtaaaattaccggtagcatacttattgacaatattcatggcctcctgaagaggatgaacaaaggctctgattagatcattgacactctggaccgttacgaaaaattccccttcgtgctccgaggtattgatggttgcattgatattaccattctttatctcgtttgcaacagccatgatagctttattggctagttttgatctctcaatattccggttgatctcttgggtctgtttgaaaagaggacggtataactcatcaaatacccatttctttagcaatatccatgaggggtctcactcttcctgcttcgaggtctgctaaaccttcctcaattcctttcaaggtttcatcagagaggggttcatcatcgacagtcatatttatcagcctctcgattacatcacagtacgtctctctaggatgttctttcagggaattttaaccggtcacctgctcattcactcttataagaacagtaaacaattacatgtgtatacccatattaactaatatgacgatctgaatgggggttgcgaaaaatcctttcattcttcagaaaatttcacttttgccccctgtatgcgacaacaggacccggcttcaggagtcgggcactatctttttcccgttgggtcctgctgacgaacgatattcaaaattaaaatccggaagcgagatttttttacctatcacacgctggattacctcattcccactctttacaatccaccaaagccagccttgattatcccctctttgagagccatactctcttctgcatgtttcccgaaatccccagattgagataccccaccgggagtcagatttatgtgagggacattccctgctgatgtattccattcttcaaagaaccaggcccaggattttggatcctgtgcaactatctctgcaaactctggtgagagaggagtggttttcaaaaagggagttcgagtcagatttccggtaccccctgtaccgatcttattccctacctcaacctttcctgaaaccgaactggaaccggcatcattgacgaccatcagggatacctggtatgttcccggcctcgtataggtatagaccggattcatatcagttgaatagctgccatcatcgaagtaccagagacggaaggtaggatctccgagagattcatcaagaaactgtataatggtgatatcagatgcgtcaatgatctctgcactgaacttcgcaaccggtaaggccggatcagtcactgctgctgactgagagaggacgagaggacaaggcggcctaatcgttggtcgtggtgtcggggtcgggaccggggtggatgcaacgatataactctctgcgatgaaggtatcagatcctcctgcattcgaagcggtgagtgataccggatatatccccggacgggtgtaggtatgatagggatgctgccggggtgaataactgccatcaccgaagtaccatgcccatgatgtaggtttgtctgcagaggtatcgatgaagagaaccgtgagtgggaccgatccggtagttggtgatcctatgaatgatgcagccggcggataggtgcccggtgtcgggaccggagcaggagttggaagtgggttttgtgcctgtatcagcccgggaacaaatgtcttattatatccggcactgttggagacgaggaaaccgaccggatacacccccggtgcagaataggtatgttcagggttctgttcattggaggttccgccatcaccgaagtaccatccccagagtgtcgggtttccggtggaatgatcggtaaactgaacggtcagaggaaccgggccggttgactgacttaatgagaataaggcgaccggcggcgtgagtgaatcagcctgaattgtctcatttgccgatactccactcctatcttcagtcatattgtgatatccggattcaaatacgaccggtgagatgatctctgaaccagccgcaatgcatggacaaagaaggaatatgcccagaataagcagtatgagatatggtgtatcacgtacggttttgtatgtcatagaaaagccccccgttatgtagaataacagatgtccatatatttataattcttaataaatattttgtgaaaaatgaaaaataaaaatttataataggctcttctcgtcgggattcgagggaagaaaggtgaagggagggaacaatgattggaaaatgctaaaaatgaagcctttgatcctatgataacgtattataccgatttattttgattttttagttgctggactatttgattgagtatgatctgaaaccggagtatatgtttccatctcaccgtctgaatgaactttatcaaggagtttggataatgattcggctaatttctgagccgctgcatgagacatatatacccttgaccctttgacaatatttttaccttcacttcttactccaggcatttcaagaaaatcaattgacacatcccgataagagacctgaacatatgccatgtttgagtatgaggtatgggtaatatccagactcagatcttccggtttatatgcatataattcatgaagatcaagagtcccgggattatttttctcacttgttttcatcaatgctacactccttctgcaactacaaacccgtgtttatgtggtttaccgtctgccgtaattccccacatttcaggagatgctgttgcatgtgccaatggtttatcctggttctccaggtttttatgataataatccaggattgcagtgtccatacaccgggttttatcccggtcatccagcagtgcatatgccaggagtgataatgctatgaactttttcgactctaccactacccgatataccggatggtgagaatcttttgacacattctctattaacccgagttggaccagtttttgtaacgcatctcttaccgtctttggttttcttcccgttaactcttcaagatatttcgggcgataatggatggttggatcggcaacaatctcttcaacaatctgtgccagcgctgaattcccaaataaccccccatatgggatgtccaaaaattcctcaagattttcgggtaattccggcaatgttctctctgacatggtattcatcccctcctgagtaattggtatcacatgacaccacctttgaatatcattggagaaggaagtgtaaaaaaatgatctcaattaataataatttttacagatcaatccaatgcctgtgatgtggcacttcaagatcatagtgtatcatccattgatcagcccaaaccttatccttcaatacaatgaccttgtttccccgtgacagatagagggcaattctttcttccccccatgtcttttataaaccgttttgcttcaaatccgttctctttacattttcgctcacaatccaccacaccgcgtaatccgccacgttttttgagccaacctaaaaatattgcaccgttctcttttggatccgggcctgcagggacagatgtattcatagaatcgtataaaaacaggtatgcgacagaaaagcatgaacattctgaaatgatgatggaaaaatgggccgggtgtgaagatagccgaaagatgaacttcagacaataccacctaaccggataacctggttcatcagcctgctattgtctcaaaatccatcacctcctggtaatcatcatccccatcgtcaggaggagagagccagtccctctctgcccggaaatatccggggggatgggtatctgcccaatgcatcttacttcccccgtgaaaggaaaggatacctgacggttacattcccatcctcatcagtcctgaccagtgagatgatccctgcctgatctgcacacttcatccagagcaggacagtacataggacattgattatcgatgtaattgcacattctgcagccagaaccaattcaatcatacgcttcctccccgaagacaatctcctcggtaacattcatagaccctgcaatatctgaagcatgtgaaaccgtgcggttttcatcatccgaatgagccttcaaaagaaggatcccgcttccgtttacgactgaacctgcaaccgttttatcggacaggatccggtgtgagagataatcaccactgataaagaggccatgcgttgagatatcatcctgacgaccgggtttttgattcagatcagtaaacaggcaggtgggatcccgtgtggtctgattgtgtgcctgaccggtatactcatctatccccatcggcccggttgatctgccggatacgagtgcagttatcgcctctccgatattgagggtgcggtttaccactgcgaggtcggaagtaaacagggatgttgcatacgaccgggcatcactgatcaccgaagacgagacccaggttgctcctgaacagacgattgatgatgagatagaatccgcttgtgtcagtccacagggtatgacgaggaacaatactcccagagtgaccagaaccttgttcatccgatctccaaaaaatggggtatcaggccagttcactgaccgtatctgcccaggtctcgacggtagtcaggatgctgtcagattcataacttgagatgctcactttgtcccgcttaaaagtgacattgtagagttctccgtttgctgcatgacatttgagcgtgatactatagccatcttcagagctatcatgtgatggtgttccacccatggcggtctcgattgtattgtctgccagaatggttgcgatgatggtgtcaaaggcacctgatgccggtgaccggaccgatatccttccgacctgctttccatcgttattttcataaatgactgtccctgaatagtattcagagctctttgccactgccggaaatgtctctccccctgatgtatagggagtgcatccccatggattgtcggcgagaatatttccgacgatggtgtttaagactgcctttcctgcaagaggggttgcgagttcccgctctgcacttttcactactgattttgagacaaaatctgccatgttcgattcccctgccgtgtgcactccggcactatcaggttgaaagggcagagataaaagaaagcagacgattgtcgtatttgagcagtaattacgctttgatttagagaatacccatggagagaaacatttcggtgaacatacaacagtcctggtatcatcagtcgggatctgcatctgaaaaattatcggaaagaggaggatcagccctgtctccttatgattccatccgatcaggcacaggtgttgactgggagggaaactcttcacatccggttatgggaattttctcaaacacgggtgcttttttgtgttttccagagaggaccatctttacccgctggaccggggtcgagtacacgctgcttccgatgacaaagtaaaacccctttccactctctgacagccatgcagaaccggagatctcaccatcagggccagtgaccggactttctccgaggccaagcaggactacccatgtttcatcgatgctaatggcagagcatcccttgccatcaatacctatccggaggagatcaccatccaggaacattctcccacaccgctcaaagggagctttccgggtcgttcggaccgtcctgactggaaacgggttcatatcttccccccgttctcgagggggcaccggtcaagatatgagggggtgtgtccggccagttcacagattcttcgtcgtgccggcttttgtggatctccccgtatcagataccgttcccagaggaggtgcggacatcctttcatggaacagatcccggtggatggccggttcatggggtacatgaactacctccttcagactttttcgactgctcccgaagataacaggcatcacagaggccaagatgggatgcatgatcataccagaccagcgggtttgtattacagacatgacactttcctgcaccggcattcagtctgaccatctgatcagtgctgatgagaccgggaaggggtataatggatgcaacatatctgctgaccgctttgttgtaacaatctgcacagagaaatgctggctcttcattctccttaagagaccgtttccggtactggacataggatcgtccacagagatgacagggtcttttctccggccacccttcgatgcggaggtagtcatccggtttgatggttgcagcaatcttttctgcatgttttctgctattttctgcagtgatccgcccgttttggttgccctgattggataaagagggttgatttgatgaaagcagggattcgttttctgcagcccggtccggacacagggattcacactcatgattaccagtgctgatcctgacatctgcagcctcttctgtgaatgtgcctgtttcagaaaatgattctctatctctaagtatatgtgtacatgtactattctgagagagatctgaagtccgttcattttctgcaggtgcagaaaaccggttgctctctgcagaaaaatttctgaaatcatcctctggatcatcgggcggagtggtggtatcatggtggtcttcatcctgctggcgtagtgatactgctccacccttcacccaagcgagatacagggagttgtcccagacgtacaccttacttctccggtgggtggtcttgccgacatctccaacagtgaccgaccgatcatagaatgagagagccggacatttctgcaggaggcctgaatacaggtgtccccgtgatgcatacccgttcagaagttttgatatggcagaattggtccatccggtcacccgctggatgtcaaggacggtgagctcttcctggtttaacgtccggatggcatcaatgagggatgcttcattgcgggtaagctttgttatctgcccgccggtgtctccgttcagggcattgtatagtctgacggcctggttgaaatcatccagggttgcgatgatgtactccgttccctcaatggttcttctctcccgctgaaactgcatgagagcggcatttgtcttgatgagatcaaggagcatgtcaggatttcgccggtttgctgcagactgaaactctatctgttctgcataggggatgataacaaaggtttcctcaaccatccgccacatctgcctgattaccaggatctcttccctgaccgatgagactgcggtcggtatctgagccgcctcccgaagtgtccgttccagcactttcttatcctgctcttcactgtcgtctatccagacggtgagcatccggttgaagatctgatcatctccgactccttcaacctttgcgacccaccagacacatcgctcggggatggtacaggtgattccgtttctgtcttttgtgacggtccggtacctgaagggcttaagaaacgaggtgatgactccttttaagatctcctgcatctgctcagagagggagacatcatcaagggcgatgacggtccctggttttaaatcctgtgaataaaagagcgccttgtcacttatccggcctgataaacggaactcttcaggaacctgggccagcatggtgtcgatggcatgcgattttccttttcctgaatctccggtgattgagacatgaagtccttttgagttgatgactatccgggaggcgagtgagaggatgaggcattctgcaacaacctgatccccgacatgatccagagcaaaggtatcacgcatataccggaccggatttccttttctgaggatctcttctgctttacgggttatttccgggctttcctcattatcagagccagtgggagtttcttgttgtatgcctgattttttgggcttcttcttctggtgacggggcatggaaagattggatatctctgatagtccaggatcagctgggtctgctccatcaggcctctctgatctctgcattgtcagaccgtcctgttcagcacgataccgtctccgggcattgtctttatgcatccttgaaagccggtcttctaaatcaggtttgccttcatatttctgtttcaggtctttccaccgctgcattccaccgccacaactattgtgatgacatccggcaaagatggctcctgattcaaattgtatggcatatgccccgtcctggtgagcatcggagaacgggcactgatcaaggataaagagggtgccgtttccgtatggtttctgcatgtatccgatctcatgcctggaaagccaggtggcaaggtcaaccggggtatcattctggcattttgagaggcacttctctgatggttggtgtcctggttcggacgggtacagggaggctagggttgcaagatggtcacaaccggtcagtgacagggatgatgattcttctgtcaggaaagcgacccggtgtgaacggggtggggtgttatcccctttccgtgtcatggtgccgtagagtttccatatccgggcagcattgtagttcgcggtatcgatggtgcagatatcatcagagaaccgggcagagagtgcattcagagatttcttgataatatctgtcgcagcatcatcattggggagatcgattcggtataaaagatgagctccgtttcctgaatcggcgatgatcggttcaggccacccgactgaatgaagatatgcagatatctccttagcctttgcaagagcataccggtgttcctcgtctgatgatgagacaccggaggggcggaccggatcgatgtcaatagggaaccagtgccttcttatgatgtctttgtcggcggttgtggcatctttttttgagagccgtattatgatccggttcgcacgcctggcaaggagtgccgggtttacttcgtttaaggtgatgtaaataccccggatctgagggttgtcgtccaggatacagacctgatcagcgagtttttcaaagtcgtcgaaatatcctgaaccgatgccgtcgttcgtaataattctgacttccaccactctgccaggggaggagatgaggtgaagggttcgcaggatctctgatctccgatcaaatgccatgaactccctcctttattgctgcaaatccaccggccatgacatggtaccggtcccagacggcagcctgcctgatccagagctggatagttcccggacaggtgcctgatgctgccatctgaaagagcgggttcatctcgcttacgagacgatcttttttgagcgggcgtctcagggattttaccttgattaagaggatctcctgccggtttttccatgcaatgatgtcaatcgggagggttggggttacgaccctgactgcggtatatcccagctcctgaagaagccggcgagctgcgtgaggggttgtccggcaggttgagtaatcaggggtatcagacatggatcatccctctgccctggtgaatgtgctgatttggatgcgatccgaagagatcaagagaggtacatatccgggtgcaaatcctttctggagatttgaacgtactattcaaagcccttgtaagcaggcccttgtccaggtggtcaggttttcttccctcgccggggccatgttgtgtaggaagagtcgcgattttttgggacaggaggcttttttgctgtccaaaaggaaagatagaaagaaccccatctgtgatgagctggccggctttttcatggttgggggattcattcttcttctgattatagctggttttcttttcctgtagctgatcctctgagagcggtgcccggaagatcagggagagatctcgttttttcgtattcattgtaccatgctccttttttggaacagttccatttgggttgattttacgattttcaatccctaatgggggaacaagatccatccggcatctattaatagataccgaaatgggatttttggatgaattatttggtcaccatggtgaacctgaattatgcgacgtgtatatcggataattgagattgatttggagatagaggtgatattattcagtttattacacgtatgacagagtttcattctggtattaggatctgacccgggattgatgacgcgggaattacgagagtccgactaaggggtgagggatttagtattgtatgaaaaaatcttctcaacaatatcaagggattctcaaatcaggctcaggatttcattgaacatttcgggtttgaggagcgcaacggaaaacttgagaagaacaaccggctctacctgatcgtccagaagttctgtgagatagatacgtatcctgaatatggcccgaggtgttgccgcatgttcgggacgcatgggttgatgagagtaagacaaagattgggtacgttattaattttaatcgatatttctatgaggacacgcctccccggtcgttagaggagatcgagagtgatcttaagaagattgaggctgatattcaggcattgtgagaagaaggaaagagataaataacccaatgcttacgcattttcatcgagtgaatccccgtgatgcaataatactcctgctttagtcggtgatacttgtgtaattcatgatatccgagaaaaactacttctttgtgatttgatttatcgaattactggtgatgagaaaataatggataaaaaatatgttagtttttactggttaagcaaatctggccggcatcaaattactcgagacgcgagaggttcaagtcaatcaatggtaaagatctctcaagagcacatattatcgtgggtaatacctatgccacctatccaagaacagataaaaattgttgaaacaatcgagacctttattcaaaatttatcaaaaattcagaataaaattttcgaatcaaaagtattactccaagaatatcattccgctctcatctccgccgctgtaaccgcaaagatcgatgtccgtgaaaccatacccactcgttcagaggcccaatcatgacaccccacgtatccacgttcgaaaccgcagaacccgcattattagaacttcttactcacattcacaccggaaaagcccagcttcctgatttccagcggggttgggtctgggatgataatcatatccgttccctgattgccagcgtatcgcgttccttccctatcggtgcagtcatgacgatggcagtgggcgagaacgtcagattccgcccacgacactttgagggagcagacgaagcgaaaggcaaacaaccggaagtcctcgttctagacggacaacaacggctcacctccatgtacctctccctattctcgaaagggccggtaaaaacccagactgaaaagaaacaggagatattccgctattattatcttgatatcgccaaatgtctggatccaacagaagaccggtttgatgcggttgtctccataccggagacgaaaaaactcacaagtgattttggcaggaggattgatcttgacctgagcacccgggaacatgaatatgagcagggaatgtatccactcccagcgatattcgatccagctgctcatatggaatggacaaacgggtataaacttcatcaccagcatgagcagacaaagactcaactcattgaccagtttaatatggagatctggcttccgttccaacagtacaaagtaccggtcatcagactgacgaaggagaccccgaaagaggcggtgtgtcaggtctttgaggcggtaaacaccgggggagtgtcattatctgtctttgaactcctaacggccaccttcgcttcagacaacttccatctccgtgacgactgggaatcaaaaaagaaaaccctgtatgatatccccgcattgaaaggagtggacgaatcatcctacctcaccgcaataaccctcctgacaagttatcagaagcaacagagtacaaattcagctgtcagctgtaaacgcaaggacgttctcaacctctccctttctgaataccaggagaactcaatcctgattattaaaggactgaaagatgcagcacaactcctggcaaaagagaagatctttgatatcaagaccatcccttaccagacccagatgatccccttatctgcaatttgtgcatttcttggacaaaaactgcagaatgatacgataaagtcgaagatcatgcaatggtactggtgtggagtgcttggagaactctatggcggtgcaaatgaaaccaggtatgcccttgatattaccggcgttctctcctggctcaacgggggagagattccggctacaattcgggatgcaaatttcagcccgcttcgactcctaacgctgcagagtaggcttagtgcggcatacaaaggactcatggcccttcttatgaagaaaggaggttgtgactttgtcaatggggatccggtagacatccagacctactttgaccaggcaatcgatatccaccacatatttccaaaagcatactgtgaaaaacagaaataccgccgggaactctggaactcggttattaacaaagcccctctttccagcaggacaaaccgggttatcggggggtataagcccagtacctacattgagtcaatccagaaacaggagaagatcagtcctgaccgccttgatgagatttttctttctcatctgatcgatcccggaaagattcgatctgatgattttgccggatttatcgaacaccgggcaggagaattactcaccatcatcgagcaggctatggggaaaaccatctccggtcgagatagcgaagaatatctgagagagataaaaaggatacaataatcgggtaatcaggtgggtgagatgatccaacatacagagaaagtattcgaggccaccgcatgataggtcgtatcaccagagtcccactccgggaggtctggaaacacgaagcccttgactttactacctgacttgaggagaatatcgacatcctaagcgagaccatcgggatggcccttgagaacgtaacccgggagcaatcagccggggacttctcccgttgatctggttgcagaggatgggaatgggaacccggtggtagaaacaaattgcgagtaaattccatcaataaagatacatagcacgtaaagttctcaaaacaaatcccatagatctcagcatcaggtttgaacccctgacagaagaagagggtaaaaaagagggtaagcagatattaccagaagccaacatgttgaccaataatgataatatccgcgattaacaaactcttttctaccagacccgagcgggcacatgcccacacgagaaaggtatgtacgatttgtgatcgtactaccattgtaattttctggtccgggttagttgtttggacgcatcttccccggactaatcttatggtttctattgcctgcttattatcgctttttctttgaaatgttcattttctattaaaagatggaattacctcaatgagaatcttgatgagttatgcgcaacccctgactacccctctttttcctcatgctcagaaactcccttttcatgtactgtcaaacgtaaccggtgaatcagggtaaaaacataagttccaggcaatataccgaaaaagcattcgaagctgcaatcgaagaccatctcctcgctcatggataccagaaaggagatccggaaacctttgaccgctccctcgcccttgaccccggagaagtcatcgccttcatcaaagacacccagcccaaagactggaattaccttgaatctcagctcggaacaatggctcacggatcatcgatgacctctccaaggccctgaactctgactatgacggatgcctgaaggtcctccgccaggaattcaaaagttacggaagaacattcaggacagcctcctttgcaccggcgagttccttaaacgccgatatcacacggctctatgaagcaaaccgactcaccatcatccgccagctccattactcggagaagaacgagaactcccttgacattacaatcctcatcaatgctatccctgtcatcaccattgaactcaaaaaccccatgatcgggtagtcctacgcagatgccatctaccagtatcaggaggaccgggatccataagaactcatattccagtttaagaagaggacctttgttcacttcgccgccgacccggaagaagtctgaatgacaacccgtcttgacggtcctcatacccggttcatcccgttcaataaagggaacgacggatgaaaaggaaaccccccgaacgggaccaactacaaaaccacatacctctgggaagagatcctggcacgggacgcctgcttgacatccttgcccggttcattcacctgcagaaagaggagaagaccagggaagggaagaaacacgtcaccgaacgaatcatctttccccggtatcacctgctgcaggcagtcaggaatgtaatttcagatgccagaaagaaatggagaataacgagaagatcgtgaataaattttttgagagtgaggagttcaaagagcaggttacgaagtatatgattgacaaagtgtatgaagagataatcgggaggtaacccaaatacttaaccgatatatcggtgaccttcgtgaactcatcaaaaatccttgaaatattatctgcatataacccgttctggatatcaggggctattgatgcgggcattcccagggatctgctccctgcctgctgtgcacaagttcaatccaaagaagtactggttctgaaaggaatacgtcactccggaaaatccacactcatgaaccaggttattcaggagctcttaaaaacagggatccttcctactgctgtcctccgggttaatctggaagagccactctttgcttcagagtattccatcacccttctcgaagatatctatcggacgtatcgggaaagggtatatccggaagggaaatgctgggtttttcttgatgagatacaacaggtgaccgactgggaatcatgggttcgggggaggcaggatacagaagacatcaagttttttgtaaccggctcttcagcatccatcctttcccgtgagatcggaacgaaactaaccgggaggaacgtcacttttgaggtcttccccctttcatttatcgaatatctacggttcaacgatgtggatgttcgaacagaactggattatttcaataaaaaaaccacaatacgaaatttattccatgaatatctcatgtatggtggctttccagaagtgacactcaaaaaaacggagaatgagaagaagatcctcctgaagagttactttgacgatatactctatcgggacatcgtatccaggtatgagatccgggatgtgacaagtcttcgaaatctcgcggtctatctgctgacacaggtagcacggcccacaaatatctctaaactaaaaaagaatttttccatatcacaggataaaacagaatcatatatctctgcacttttggaaagttacctactctttcagataaccagcttctcgtattcattaaaacattccatgcgatcaggattcaaaccttatgcaatcgacaatggacttcgtaatcgggttgcattctcattttccgaagacaccggatggcaggtcgaaaatgtcatcgcctgttttctcaggcaacagtatgaggaagtgtacttctcgaaaaatggaaacgagatagatttcatcgtaaaagaagggatgcatatcaggcggcggattcaggtctggtatgatgacatttcagtcagggagataccttcacgtgaattagccaggtttatcataccgcttcagggagatgataatcctgaatccattttgcttacgaacgattatgaagatgttatcgaacatgatggaatatcgattcgatgcataccggtcgtgaaatatctgttatcatggtgagtgatttttggcagagatggtaccaggtgacgggaaaaatggttgagagatattcaggggagatgtaaattttggtctgaaacccccgttctttcttattaacatacaaatgaccgcggctccgatggacttcagataatatcattttatccattttatcaccctattacatcatatgccatcttctgacctcatccctatctatcatgctgacaccggaaccgttcgggaactcaaaaaggtcatcagaaccgacgaagaatggagccaaatacttgataaacccgtctttgatgttgcgaggaaaggagggacagaaccggcgttcaccggggcattttacgcaaccaagatagccggtctctaccggtgtgcctgttgtgggacagacctcttctcgtcagtggataaatttgattcagggaccgggtggccgagtttttcaggaccggtgtcagccatgaacatcaggaccaggaaggactcaggttatggaatggaaagaaccgaagttctctgtggtctttgtgatgctcacctggggcatgtctttgatgacgggccaccacccacggggatgcggtactgcataaactcggcatcgctgatcttctttccgggaattatcacaattcggcaggagtagctcaggatcaacatctcctgaaatacttctccggcacagtcatctcaaatctgacccctttacccggtgtcccggtctcttttatactgatatcggtgatagagaggatctccctgataaggaagagaccaagaccggtattctttccatatccccgtttgaagaccttctctttctcatctgctgagatcccggatccattgtcctcgtagataatccggagaagagactgttcatccacataggagatccggatttcagtcactccgccaccatgacggatcgagttctccacaaggttatacatcaccttgaccagcatctggtcggcaaatatctcataacactggtccgggagttgcacggagatatcctttacaagacctgatatggtaggatttgtaaaaattaccgggatacgctgccacataggttcaagaaccccgagatcctggtaactcctcgtaaactcgatcagatgctggatctccttcccgctgaactcaatcgcctctagttgtttcttcagcttcggatctgtaatcacttccttgagcaggaaacagtaattcacaatcaccatcacatgattgagaatatcatgccttgtaatggaagagaggatattgagcttgttatttgcctgggagagggcagcatatgaccgttcgagctcttccttccggctgatcagctggtcccggttatcagcaagatttgctaccatccggttaaaggaaagagagaaatctcccatgaaatcaaccctttgagagagatccccctctgcaatcatctttgcctgccaggtaaggtggcggagtgatgactgaagagccttcaagggacccgcgatatagccccgaaaagagagctttgcgtccagatccccttcagacatacgggagataaaagaatgcatctcatgtatctttccaagaattcgtttgagtttctcctgttcctccaaagaaccggggagatcttttggaatatctccccctttctcaatcatatcttcgatcagggtcagtgcatcctgacctgaattctcagtcatggaaaacctgtcaggaactgcggacattggcttcaaaccggcaggtcctatctccggtgcaccagcagtcaacctctctgacctcgtattcggatccggtcatctcctcaagaataccccggataaacccttcgtcaaaggtacataccggataattcagctcaggaagccctgaacagtcaagatcctccgcgacggtgagggtaaaactgccactcagctcatctgcctcctcaacccggagaattccgatacccagctcccggagtgattcctggaatttcctgatgaaatcatgcatccccgtgcatccggaaagcaggtggtgataatactcccttccagataaccgtccggcttccctgaatattttgtctgcttcagcatcaccgtaccgctgctcaagcacatcacggagcgtatattgcatgagccggtagatctcaagccgggtagtgttcccaagattcggtctgcccttctctatatctcctaaaagctcccatttgaactcgtattttcttgactggcccataatgtatctcatatgttttggtacctataatcactttcctcttcattcataccggattttcagatatagagtacagcaacttctccagggtcggtctgaaacatcctgatattatagtgttttacacatccgtcagctgaaagggggacattgtctatggagtcccgaccgccttccatggcaatcttcctgcaaatgatacatatcttccggccttcatcatctggaaaaacctcttcaatcacttttccaggggcacatctcccgctcatcccagtcatctcttcagcagccggattgccaccatgacagaccagtcgtccatcggcctctatcctgaatagctgcagacctaccggcagatgctgaataattctgatcagcttttcttctgactctttctgaggggtaatatcccgaagactctctattgctccggctattttcccatgctgatcatacaggaaagatgctctggccaggaaaaagtgtttccttccggcgatatacaacactccatctgcggtgatgatggaattttcccggtgaagtgatggataggaagcttcaacaccaggatcagggcgaaggaggagatcaatgatcatgggccgtcgtgatccgtaaaacgggactgcatgggaatatgcacccctcccgatcatgtcttcagcacgggtaccggttatccgctcaatctcccggttccaggcgatgatgatcccctcagtattgatggcaaaggttgcgtccgggagaaaattgatgatgtcatggaaccgctgctctgatgcttttattgcctgaagtgcccgtctccgctcaactgcagtctctatcttatgggcaatatctgcaaactgaagctttgggtcgcctcctttctggacataaaagtccactccggtgttgaccgcatccccagcaattgcctcatcaccgcggccggtaaagaggatgaatgggatatcaccacactgttttctcacaaaacggaggagctcaataccattcattcccggcatctggtagtcggagatgatcacatcataggtgttctcctgcagaagtctgactgcctcctgccctgacagaaccccggttaccgaaaaatctcctgcccgtttaagaaacagacgcccaatatctaccaggaccggttcatcatcgacaaaaagcacagagatcatatctgatggaagttctcgcgtatacgatgattaaaggttgtggcattcatcataagaagggagagatcttaccctgatacctgatcaatatctgaactctcggagtattttccggatttgccggtatacccgatacgataatgcttttcaagaaatttcaggatcttttctgattctatccaccggctgtccagctggtcaatcatcttatctatctcccagacctggtgcgtgatccgggggtaggatgtctcatcctgaaactctgcgcaggccagaattaccgcaagcgggtttctaatcccgtcgttgaggattgcaagctctgcaaggtttcgtttgagctggaagactgcggttgcattctcctcttcaagttctttctccctggtgatatcgactccaagagcgatggttgcccggagtgatccttgattatctttaatatttgcggaattccacttcagtatcctgatatctccggttttaatcctgaccggtatctcggttgattcaagatgcatgccaaggctggtgagatggatgattgaaaacaaccgttcggtatcatcttcggggagaatgcaccggatggtcctgccaatcaggtcatcctgggcatacccggtaagatcctcaaatgcccgatttacctgggtgatgttcccttccttatcccagacgatgatcggtgtccccgcatgggtgataagtttctggaggtattcactcgtctctctcagctgctcttcagcctttactctccgggtgatatctgaaaatatcatcgcaaaaccagtttcaagccagggagatacggatatggaaaaatattttgaaggccttttgagaaatttttcaaagaagattggggtttttgattcaaccaccgaactgcatgccagaaggcaggggacgtatccgataatatctgatatacatctccccctgaccatatcagctgtataattgaatatctcctcataccggaggtttacatcttcaaacctgaaatcaaccggattcccgttctcatcccttatgagcgtgaagagagcaaccccttcggccatgtgagtaaataaaaaccggaaccgctcttcactctctttccatccctcttcagatctcttcagggacacgacctgattgatccgatgagagagcatggcaaaattataggcaggatcaccttctttggtaagatatccggacaatccatcattaatcgcctctacaatctccatctcctgcccacgacaggataccaggataaatggaatgtgatttccttgttttctgagtatgcgcaggaaatccaaaccggataacaccggcatgatataatcagagacgatgatatcatactcggtttgttgtaagcgcgtgagtgcctcttgtgcagatgatgccgtatcaacgacaaattccccggttttctcgagaaatgtctttgataagtagagcatatttggctcatcgtccacacaaaggacagaaatcatcatgatatggatgtatggatataactaaaagattttgcactgcatgggctggtgaattaaccacgtctttatgcaggcatggtgagaaaatacccccggaatagcaaaattaacaggatatatctgcagataattcgcaattatccctcaccccataattaatcactcatacggggggatcagcacaaggaaaagaactctgcctgaatattctggttaagaaaagggaggagaaataagaataattacagataattattccgacggagccaatcccgctgagggggagtgtaccggtaggttatgtcgcatttgtcgtcctgaaaactccagggcacgatgatgataatatcaccctcccgtatccaggctcgttttttcatcttccctttaattctgccaagacgggtaaccccatcagagcaccggaccctgatgtgatttgcgcccatcatcagctccgcaattgcaaactgctcattattggattttttaggcaggcgaacccggataatttcatcatccggaccggccttttcagatgcacctacttcctcttcccattcatcgtcaatattactaatcaaacccactccggatagtaataattgatgtttagtttttctaccagaagaaagtatgtgcaaaactcatatcatcgatgatttccgattcctgataaaatgatggtctgcaccacagcgagggtaaacattcatggttttgcaccattataatttataattagaaccatgacattagacctccatgagctcaaaacgttgcttgatgatgtcagtgagggccaccgcctgacagtcgatgaggcagagaacctgtttaaagtccgggatcgttcatctttttttatcactgcagctgctgatgcactccgggagaagagatgtggcaacgctatcacctgggtgaaaaaccagaatatcaactgttcaaatgtgtgtgtgaattcctgtgggttttgtggatattcctgtaaaccaggtgattcaaaggcctttgaactgacaccggaattagtcggagagaaagcagcacttgcagcatcacggggagtaactgagatatgtaccgtgagcggactgcatcctgcatatgacctgaactcatatctctccatatatcaggcaatcagggagaatgcaccaggtgtccatatccatgcctcaaatccgatggaagttgcatatgcggcgagaaaaacaggatgttctacacgggaagtacttgaagctttcagggatgccggtgtcggaacattgtgtggaactgcagccgagattcttgtcgatgagatccgtgatgttatctgtccggagaaaatatccaccgatgattgggtacgtatcataaaagagtcacataacgctgggattcggtctactgcgaccatcatgtacgggcattgtgagtcggtcacagaccaggtcaggcatctctccatattacgggacattcaggatgagactcatggatttactgaatttgtcccgctgtcattcattcatcccgggactcccctgtaccggaagggtatggcacgtccgggagcgaccggaagagaggatatgctcatgatcgccatctcacgactcttcctggataattttaccaacatccaggtctcctgggtaaagctcgggcttaaaatggttcagattggccttatgtccggtgcaaacgatatcggtggcaccctttatgaagagagtatatcatcatcggctggtgcaaaggctggtgaatacctggaccctgcagatatgcgatatatttctgaggatctcgggagaactctggtagagcggagaacagattattctccggtgcattaactctttttcccgtcctgattgggaaatttaaaaaaagttgaatgattaaaccgggaagatctttctcccgtatacttcattgataacctgtcccattccgatgtagagggcaagaagaccggcaataagtcctgctccccctccaaggatacccagtgtggagattcccgtcagctcaccggcgaccagaagagctactaataccacgacgaagaacaaagtcacctgcagtacccggtgcatcctgaatgaacagacaaataatccaagagcaaaaaatccccagacactaagaaatgctgccagctcgggatttgtaggtgcaccagatgatcatctaaatgttattgcttgaaccacaaatatgctacctgaagagagggatgaaccaccctgttctctctatggaacaggcaacctgatgacctcaagggatatatcaatgtgcatgaaattgaatcatcgtccgcagatgagatggggactaggcataatatgtgggatatgtctgtttttgatgataagcggggtcagtgctctcccgcaggaagaacgggtaccaaccatcatctcaattgccctggacccggctcacccgcagatcggacaaccattttacattaccggcacactcatctcaagcaccggagaacctctcgggaataaatggataacgcttgaatcaaccgctgccggtgcaacgccaggaaaattccagtacctgaaagttaccagaacggaacgagatggatcctatatgttcttcagaccggccgcatctcccccggaggatcttcaggtacggttcaaaggattgtacccgtatgctgcatcggtgtctgatgtggtaacggcaaaaaaataatttttatttgagaaatgcgagcatcgtcgcggtctgattaaaccatacctatatcctcattccagagttccggcttttcacgaataaaggtctccatcatcatctggcaccgattcaggtcataatcaatgaccgttaccccatgggcctccataaactcccgtgcaccggagaaggtccgtgattcgcccacaatgacccgggggatgtgaaactgtacaacagccccggcacagaggaaacagggcatcagagttgagtagaggatacaatcctggtatgaaccgatccgcccggcattctgcagacagtcgatctctgcatgaaccatcggatcattattctgcacccgccggttatgaccccttccgatgatgacaccatcccgcaccaggaccgaacctatgggaatacctccttcttcttttcctttctctgcttcctgaattgctgcttccataaagggatcgtccaaaaccggggctgtggggggaatttcaccaactacttcatcctcttctctccagagcggatcacagatcgccagaaagatgaggtctcgcgtgccggtgttctcaatccactggacctttccaggtggaatgtacgccagttgcccctcaccgatctccatatgctcatccccgatatgcattatcccggtcccggaaaggatgtagtatacctctgaagacctgataagccggtgaggaagggttgttacgccaaccggaacctgtgcatgggctatactgtaccggcactgtatgtcctttccaattctgagcggatgaaagagctctgcaaggaggcagttatctgcaaccctcatatggggaattctgacatcatagacatccatacatgatatgttcatggaaaccatgtatgccctgtcatgcgagatacaatccgatgaatttaagtactgatgcagactattccacaaacaggaggaagctcatggacgattcaaaaaagtatacattaccggccctttcctttgagtatggcgccctcgcaccatttatcacggagaaacaactgaccctgcatcaccagaagcatcaccaggcttatgtcaccggtgcaaatgctatctttgaaaaactggagatggcacgacgtgaaggaggagatctggatcaaaaagccctgcttaaagaactctcatttcatatcggtggacaccggcttcacactctgttctgggaaaacctggctccggctggaaaagggggaggcggtgttccgtccggaatcctggcagactggataaaccgggactttggatcccttgaccggttcaaaaaggaattcacccagacagcttcctcggtagagggatcaggatgggcagtgctctcagtctgcctgggaacacaacggctgcttctcatgcaggtagagaagcataatgttcatgtatatcccggttttcgtattctgatggttctagatgtctgggagcatgcatactaccttgattacatgaatgaccgggcaaagtttattgagaacttctggaatatcatcagatgggatatggtaaaccagaggcttgaagcagccctgaaaagctgatcatttcattacctttttcttgttatccgccaattcaatcatactatttcttaactggaagaagaattgattaatatggcggattcatcagatctgaatacatatctgtccgggtatcagaatcaggattgtcagttgattctgaacgatatcccgactgctctcctggtactggcagagaaccggatcatttttggaaatgcagcggcagttcgcctgtttaaagcgcgccaatccgacgaactcaccggtaagtatctctcagatctctctcctacctcccagcctgatggatcatcatcagccgtcgtcattcaaaacctccttcaatcggttcagaaagggaagaatacccgtttcgaatgggtatttacccggtttgacaaatcagaaatttccggaaaggtaacagtccgccagtctgaagcatccggttcttcttacctcatcctcaccatagtcgataataccgctgaacatcacgctatcaaagatattctggaacttgcagaagagatgaagaaaggaaacctcaggtcacggctttcttcagagggatatcagggtgatatgtacaaactcatcaccggtatcaatgccatgctggacggtatcctccatccgttcagggatatgaataaggttcttcagaagattgccaggggggatatgtcagggggaattgagcaggtatactccggtgagcatgaaaagatacgcaaagcggtcaacggggttgcagatatcacaaggaaagtccatgaagagatatcccggatggtcgatgctgcaaagcgtggagatcttgcaaaccggggaaacccagacctcttttccggtgagtatgcagccaccatcagagggataaatgagatgcttgatgcaattctcacccccatccgtgccggtaaccgtattcttcagaagatacagaaaggagatctcagtgagcgggtggagattgaatgcgtcggtgaccatgccaagatacgggatgccataaatgcggtacatgactggctgaatggtctgatcatctatgtgaccaggatagcagacggggatatgaccgcagagatcatgcaggcatctaataaagaccagatacatggcccccttgtaagaatgcgggataatataaggagcgttatcgctgatgttgatatgctggtaacgtctgggtctgaaggaaaactgatggtccgggcagatccctcaaaacataaaggtgatttcagaaccatcatcgaaggcatcaataaaacccttgactccgtcgtaatcccggttcatgaggcgatggaggtttcaaaagggtatgccgggtatgactttaccagacggatgaataccagtatcatatactcaggggagtggaaggcatttcagcaggcccttgatgatgtcggccaccatgtttcagatgcaatttcgatcattaccagccagatagacgttctcaataaggcaaccgcacaggcatcagccagtatcaaggatatctcatccggttcatcacttcttgcagagatcgcacagaatgtgagtatgaaagcagaacaggggggtgaagggctctcccagattctgagagcgatggaggatctggcggtcaatgtatctgatgtttcatcacggaccgctgaggtaaaccagatatcctccgataccaacaccctttccaagaagggatcggctctggctcatcaggctgagcagggaatgaaggagatcaccagttccactgatgttgtgaccggtcttgtccatgagatcatggaggagatggggaagataagtaagatttcactggtcatttcagatatcgcatcacagacaaatctcctcgcattaaacgcagcaattgaagcagcacgggcaggggaggccggacgggggtttgccgttgtggcaagcgaagtaaaatccctggcacttgaatccaggcagtccgcggagaatatttcagagatgatcgaaggcctgacaaaaaagacacaggatgcatcagataccatggataagagtgtcatggtcgtcagggagggaggaagggcccttaatgagacacttgaggtatttaaccagatcatcgattcggtaaataccgtcagtcttcagatggataatgtggcaaaggcagcagaacagcaggcagcagcagttcaagagatcacggcatccattcatgaggtaaatacgctggtttcaggaaccgccaaggacgctgttgcatcagctgcagcaagtgaagaggcagcagcagcaatcgaccagatatcagaacagatagcacaggtccataaggttgcagaaaacctgaatactgagactgaaaaattctcagtttaaatattattttcggcctgcttcagagcagaaccggttttttatatcagcaggggagagcgggatattggaggctttactgtttcccggtctgatgatcacatgaataaatgataatcctccctgagcttgtgcatatgcctgtttcagttcatctggtgtatgcactttccaggtcctgtgaaacccgcttgcctgagccaggagttcaagatcaaccgtgctgtgtgcaggagagcactggttcccggtgctgccatacactccgttgtcaagaccgatgattatcaggtttttcggggattcgctggcaatgacaggaaggacagctgttccaagaagacttccgtccccatccaggacaaccaccctccggtctgttccaagagcaattccaaatccgagaggacttgcctgtgtgtatgaaccaagcatgtaaaaattggcaggattatctcttgcatggtagagttcctttgaaggaacaccgatatttgaaacgaccagttcatcggtcatcatagacgcaaggacacgaatggcatccgcccgctgcatgaccgggtttgaaaatgctccctgataggagagatggacggttcgttcccgaatcggggcctgattgattggggggtgttcctcctctccttcccagacctttggtgagatgagagcaacatgaggtctgttttcgatccaggcatcactgatgaccgaggtgatgcggtcaatatcttcaggctccctgatgatcgtgcagggaatgttgtataatctcagaagatccgggatcttctcattaaacgggatctgtgctgatattttctcctgataatatcccctccagcttgcaaggattggcaggggaagcccgtacagatagggaagagtcatcagggcattgagagaatttccaaggcctgaactctgcatctgtaatacgccacgttttcccatcagggacaggccggacagaatcccgataccgtcctcttctcttgagatggtgatgtaccgatactctttctcaaggatctcacagagatcttttgtccgatcgcagggaagcgagatgatatactcaattgcttccttttttaatatcccggaaacagtctgttcatgcataatatctcatccattcctgcacctttgcagatatcttctcaaacggtgtctctttagataccatgatatcaggcgcttttacaaaccgggggagatcttttctccctctggcgtatcctcccccggtgatattaaggaggatcttttcatccggcttgattacacctgaacgaacggccctcatgagacctgccacacacaccgcagcagcaggatcaggatctattccttcagatgaagagaagagctttcctgcctcctgtgcatctgctgatgaaacaccggccataagtccgtttgttgcgatgagcgtatcaaatacccctccgacaatgccatagggaggtgtccggtttgtcaggacatctgaatatacctgggagatggcttgttcagcatcaggcatatcctcatcttttatctcccgtctcttctcctgccaggctctgaccatcggaatgaacggttcgttctggaagagaagaaggcggggcattcttgtcccaaaccggccgtctgcaataagcctgagcgaggcctcatatgcagcgatgcccccggtaccgctcccgactgcttgcagataccagtctggaagtgttcccatcgcaagggttcctgccagcatgacggtgcccatgccatcccgcctggcaacattttttgcccctccttccgggaatatgccagggagggtgcagatcctgcttcccagattgatggcatccgtataatctccggagatggtgatcaggagggtatcatgtgctggtgaggtcgtgaatagccggtcgcgtgctgattcaggaacgacaatgataaccggctgacaggtctctgccgatacctcggcaaaggcccggcccgtattcccggcagaggaaacctggatgattcccttcgtccgctcggaaagccgctgcatcgtcgggaatgcttcaaactccttaaatgaaccgctcacggcaaaggcccccacttcaggccagtacccggagaagacaatccagagatctgaaagacccaatgcccgtgcaagaccttcgcttttgaaacagaccggttcagcccgggtgcgaaggactcctgtgaccggaagccagtccatatatttgaaaacccccggtgcatcatggagcgttatctgacgtgcagcatatttcgcccgaataagtccctggcacccacccggacaggtaagggtgtaggaatcagaaaactccttgttacataccggacaggtgagcgtatatccggtcatatctgaaattcacccctgaccagcatatcccgcactcttctgcagagtatctctgctcttctccggtcagactgccggagaacaatcggaatgccagctccttcatacgtgatagaaccaaaatttccttcatataccgaacccttgcagatctgcacacaggttccgcacacaaagcactgcgtctgattgatcgtcccatcttcccggattgcatcaactggacatgcagttctggcatcacagggagaacagtgaagacatcgctccggatgatacaagacccgtgttgcagttccggtccacacctgttcatacgaggcagtcccaaccggctgacgatcactgatatccacaaccggcatggcgatatcacaatccaggacagaaagggagctgaggacatccgtgtcaacaaccggaatcgcggtcccgatgctggttatgcactcaggccctgcagcggtacgaaaaccgccacaaaaatgtgcatccatctccttcaggtcggcatggacagagagattgggccgataaggagaactccgggttccggttccgatcacccggccaccagccccgtttaggatcactggagaaccggcagagaggaaccggagggttggatcattttctaccgggtttatctccccgcatccggagacggtagcctgtgtgctggtgccctgaagtggcagggcagaaaatatggtctttaccggtccgctgctctgattgatgattgcagagtagttcttaaacgcactccgggtagtaaataaccgggcaaacgggaggtcagaaagggttacatatgcctcatagtcctttccggccgaggtaactgcgatatgaatctcttctccggcaataaggtcatggaagagatgtccgcctccgtaccggtcatctgcatgggcggtcccgaataccatcagatcaacaagtcccagtcgttcattcgggcaggggccgggaattgccggcaccccattcagtgagatagtatctgctcgtgaaaaggtaccgggaggagcaaccgggactgacaggaccgcatatgtgcctgacatgaccccgcaggtcccacaggtgacaacatcaacatcagagacggtatctccctgtgtaattcttttcttcaactccgatgccgtcaggataactgcagaaccatcggcaagagcagtccggatctcatcgattgatctcataaaagccgtatatcctccacccgtacctgcagaccttcctttctggaaaatacctggttcacaacgccggtatgagcaagattcatcatgcagtacgcagggagaaaccgcattctcctcccaaataccggtacctggcggacactttcaaccattccttcaaacccgatgatatgataggcctcaagatcttttacctctctcccccgtgaatagagagggcctatgacatgggttacgattactcctgatactttatttgctgacaataccaaaaggacatgctggaccggacatccggctcccatgggccgtccggtgaggatatcacccggctgaatctcccatttctctacgagatcaggtctgaagggaagaaggatcttcctggccgagcattccccaggtaacggatgcaggataaaatcgaaggaatctccaaggatgtcaacagtccccggaactgcctgagtgcagggtatctcctgacagaggtgctgagaagagaacgggcattcctctttttttcttgtcccggactgaattgcggcgaagaactcatcacaggtcccatacccgcatgcaccacagttcctgccgggtaatatccagtcctctcccatcagtcacccctgaacataagtgcatctccgtcaagttgacgaagaactcccgtatgatgcttccatccgatgttcgtctttccaatgcagaccgtacagacgccgagcggagggataccccggagggtgatagtggacaggttctcaatatccggtgcttcccctatcgctcttgtcaggtatcgcataccggtcccctgcacggcattggtctcaacaatatcaatatctccccgaatgccccgaatcttctctctgaacacttccttctccgcttgtgagacgagatcgatcctggtcactaccgcgatatcggcaagggctatcatgggtgccatctttgcaggtgactgtatgccggagattgcagataagacaacaataccaaatgactgggtcgtatacggagtgcatcgcagacaaagacctgcactctcaacgatgagcatatctgccccttctttcctggcccactctatagcctcatcaaggatcatgattccggcatgatctggacagagatcgcctgagtagaccttttttgcagggatatgaaactcattcctgatctcttcatcttcggtggcacagaccacatctatcttcaggtatgcagatttgagctcaggatgggtcctgattatctgcctggtgactgcagtctttccagccgagggagggccggcgatgataacgagtttcattaccaggatcccggaacgggcgtggtgatcagttcaccggcacgaatcatctctctcatccgcccgataataccatccatgtgaagcatctgcctgattgcatgctcttctgccccgtcaggctcgatgacctttgatactgccccatcctgcataacgattcgccgatctgaaagcagggagaccaggggatcatgggtgacaaagagcagggccttgtgatgctgacggaggacttctatcaccttttctttgaatatccctgcattctcaacctcatcaagcagtattatcggtgtgtttgagatgaggatagcatctgccaccatcagggatcgtgtctgtccaccagaaaggctggtcatccggacatgggcggtgataggttctccggtgaactgatttgcaagattgatggtctcctgaatgcaggactctttcatatatccacgggagaggagatgcattcgtaaaaagtcagagacactaaggtcacacaggcaccgggtattctgggtgataagggcaaccggttttgctgccgggtcacggacataccgttccggaggaagtttcccattgaccaggatctgtcgcccggttaccgtatcccggttagcaaatatctcgatatcgttgataaaggcactttttcctgacccggtcggaccgacgatggacagggtatcgccaggtctgatgtgtatctcatcaaacgcctcctctatccccttacggttccgtccaggtagtatggttatatccctgatggtttcctctgtcatcctgaatatatagtaggcgagtctggataataacattaccccattatataataaattaatacaatgagggaataataattgagataatacaatactttagtaccatattatcttcttcaatttagaccgatgcccatagagatgtaaaatagaacttatatagagacatcatatctctctatagttctccataatctctagaacatactctcatgtaggtttcaggagcatcatacagaacctgtgtagtccggaccagattgccaatgcacatgttcatacctccgcatacaatagggtaacattcaaaagtccggaaacgccgtgttaaggagtcagagagatcgtgacaactggtcagcaaaccaccctgaaattccgtcagaaacgaagaccgcttgaaacgaccatgcatatcgtatggtttatctgtgccatttcttcgatcatcggcatatttttcatcctcatcttcctgctttatgatgcagcaccggcatttctagatatcggccttattccatttctcaccggggaacgatgggatccgaccagtatcatgccaaagtacggacttgtccccctcatcgtcgggacgctgcttgtcactatgggagcaatggtttttgccgttcctttcggtattgcctgtgcaatcttcatcgctgaacttgcaagcccccggatgagaaatattctgaaaccggctgttgagcttcttgccgggattccatctgtggtttatggattcttcgggcttgccatcctcgtgaaatttttacaggatctcctttcggtcccgagcggagagtcggtccttgccggatctatacttcttggtatcatgtcccttccaaccattatcagcgtatcagaggatgccatcagttcagttcccagatacctgaaggaaggatccctggcccttggggcgacccactggcagaccatatcacaggtcatcgtccctgctgcactgtcaggtattaccgcggctgtgattcttggaatcggtcgtgctgtcggtgagacgatggcggtcatcatggttaccgggaacgcagcgatcatcccgtccccaatctggaatatcctttcaccggtccgaaccctgaccggaacactggggattgagatgggagaggttgcggtcggatcactccattaccatgctctgttcggagttgctgttattttacttctcattacactgatcatcaacctgacagccctgacggtcatgaaacgtctcaagagttcacagacaggaggatgctcacgaacaggagtattctcatgcctcatgatcacagaccggctgtccgggatcataccgtatcttccgattggagtgacagccattctcggactattcctacttctaatcggattatggcagggagcggcaggtattctgatcctttatctaattgcacgactggtggaccggtactgtatcaggcagacagtgcagaagatctggttctctctgatcacgatcatgatgggaattgtaacctttatccttatcttcatcctgtatgacatcttctcaaacggtcttccttatgttacgcttgatttcctgaccgaatcaccgcgaaacctgggtcgcggaggaggtatatttcctgctattatcggaacattctacctggttattggttctattctcatcgctctgcctcttgggatcggagctgctatttacctcgtggaatatacgaaagagaacatccttaccaggtttatcaggacggcaacagacctgctgaacgggactccttctatcgttttcgggctgttcgggttcacctttcttgttctcttccttggatttggtatatcactccttgccggcatgattacccttgcccttatggtcctcccaacggtgatcagaacgacggaggaggcattaaagagtgttccggacagtcttcgtgaaggatcgtatgcccttggagcgaccaggtggcagacggtccggcgggttgtcctccccccgtcggtccccggtattatcaccggtgccatcctctctatcgggcgtgcagcaggtgagacggccccgattatgtttacagccgtcgtattcatgcagcgacgccttccggattcgttttttgatccggtcatggctctcccctatcatctgttcattctggcaaccaatgtcccgggcgccagaaataaccagtatgctacggcagtcatccttctgatcctcgtaatcatgatatatggaggagcgattctcattagaaatcattatgataaaaaaatcaggtggtaacctatgaatgaagaaattatcatcgatgtgcagggtttaaacctctggtacggggagaatcatgctctgcacaatgtaactttgccaatcccgaacagaaaggtcactgccctcattggtccctccggatgtggaaaatcaacccttatccgatgttttaaccggatgaatgatctggtttcaggttgtcgtgtcacgggggatattctctatcatggacagaatattaacgggacaggcgcagacccggtagatcttagaaggaagatcggaatggtctttcagaaaccgaacccgtttccaaaatccatctacgagaatattgcatacggtccacggattcatggaataaaaaacaagagagatcttgacgagatcgtggagtcatgccttcataaggctgcactctgggaagaagtaaaagaccgtttgcatgattcagcaatgagcctatccggaggtcagcagcagcgtctgtgtattgcaagaacactggccgtcaatcctgagatcatcctcatggatgagccatgcagtgctcttgatccgattgcaacttcaaagatcgaggatcttattgaggaactgaagaaagaatactgtgtgatcatcgtcacccatagtatgtcccaggcttcccgcgtttcagattatactgcattcatgtaccttggtgacctcatagaatttggggagaccagacagatatttgagaacccacacaaagaattgactgagaactacatcaccggaagattcggataagaccatgactgagaaagaacgttctgaactctcacaaatccacaccgatgcatgtgatttaggaacatatgctattaccatgctccgggacagtattgatgcttttgagcggggagatacacaacttgcccaggatgtctgtaaccggaagattgagctgaagaaacgatttattgccacagaagagaccatgttcagacatctggctttgtatcagccggttgcacgggatatgcgggagattgtcgcttcgcttcgtatcatctataactttgagcgtatcggcaggatgggatatgatatcggggataccatcaaaaccctttcacaatgctgtggtcttgcagatcctgataaactcatcattgtcgggagaaaagtactctcaatgattgaagatgcatttgatgcatttgaggatcgtgacgtgaaccgtatcaggaatatgcgagagcgggattcagagattgatcgtctgtattgtgaagttatgcgggatctcatcaaaagaatggaacagaaaaaagatgatgttcctatcctcgcacggtatgtcatcattgaccggtacctggagcgatgtggtgatcaggcatgtaatattgccgagatgacgatatatatggtcaccggcgaacgagtagaaataacctgatttttcccttttttatcatattttcatactgattttttctgaactttggtattggtttcgtatcagtatgaaattgtacacccatctcgaacggctctctgaccagaaaaatagtaatgagccggatgtctccataacacctgttatatgaatatcaaagggagaaatgagaggcaatagacagtacagtcagcgatcgtaaaaaaaggaaaaaggaaaaaagggggcttaattggtaaggggaacaaacccttcttcagtaacgatcttctgcccttcaggactgtcgatgaaggcaatgaattcagcaataattccggatggctcaccattggtcaggaaattaagcggacgggcaatcggatatgatttgtcctttaccgattcaatcgaggggattattgattttccatcaacaaggatcggcactgcgtggatggtctcatcgatgtagccaagacctacatacccgattgctgcaggagtctgtgcaacactctgttttaccgcaccatttgagttcttttcaagctgagtcggaacaaaatcctctttgttcataaccttctcatggaagaactctcttgtccctgatgcactgtctctgccgatgacaacaattgatgcatcattccctccaacttctttccagttggtaatatttccgttgtaaatagcttttacctgatcaagagtaagagaagcgatcgggtttgtcttgtgagtgatgatggctattccatcaatggcaatctgatgctcaagtaactcaggatatttctctttctcttctttcttcagatcacgggaggccattccgatcatggcggtcccttctccagccgactggactccagccccggaacccccaccattgacctgcacatcaacacccggatgagtatccatatagatttctgctgcctgcgctgcgaccggaagcacagtggttgaaccggtaatcgtcagaacaccggctgctccgggctgaacctttgtttctttcagcgggttttcaccggttgaaaccggggtggttttttcagtttcagttgtccctgtacatccgcagaggagcacggcacaaataaatagtccaatcaggataattcctgatacaattgtagtcttaccagccatggtaactcacgtatcaacacctataacgaaaccagatattaaactgattatctccagagaatatagagacatcagatatctctatagtgccatagagatatgaatgtctgacatctggagacttatttatagagatagacggtacttttactattcactggtcattttcaggatcagaatcttcaattataatttgcataattttcataactcaataatctggacctcccatgtatcgcgtgctgtatgtagatgacgaaccaggtatcctagaactggtcaggatgtacctggaaagttatggatcaatgcttgttgatacatgcccttctgcagatgaagcaaaagatcttgtcagaaagacagggtatgataccatcgttcttgactactacatgcctgatgtaaatggtattgattttttaaaagaggtaagacagagcggacttgactgcccgatcatcatctataccggcagaggcagggaagatgttgttatcgatgctctcaataacggtgcagacttttacctgcaaaagtcaggagagccgggcagggaatttgcagatctttactcaaagatcaaccttgccattcagaaatattatgcggaaaaacgggtgaaagagaccactgcgttacttcgttcgacccttgaatccaccgcggatggtatcatcgtcgttgacagcgaaggaaagatttgcgcttggaacaggaaatttgttcagatgtggaatatcccctatcatcttgtggaaggaggggactattctgcgattctcagttatatcctcccgcagataacaaacccgaatcattttttcaaccgcaccgattaccggatcagagaaggaatcagaccggggatagatattattgaactacggaacgggaagatgtatgagcggtactcccagccccagatgattgatggggagatagtcgggaaggtgtggagttttcgtgatattactgcgaaaaaaagtgcagaggatgcacttcgggagagtgaagagcggtttcgtctgctctttgaacaggccccggttccgtaccagtctttgaatgaaaaaggggagataatcgaggtgaatgaggcctgggtaagactgatgggatatgagaggaacgaggttattggcagatcgttcatgacctatattcctgaaaagtgtctcaatgattttcaacggttcctccttgatatctctgaatttggatcaatgtatgaatccgaacttatcatcctccactcgaccggaagagagatcccggtcatactatcagcaaagatgctgacaggagggcctgatatgggagtgcggacgttgtggacgttcaccgatatttcagagcaaaaacgtatcgaatcccagaaagaagaagttatcattcagattcagaaaaatcttgccgaattagccatattaaatgacggggtcagaaatcctctcaccgttatcgcaggacaggcagaactgactcttggtgatagagctggaccgatactcgcacaggtgagggagatcgaccagatgatagaccagcttgaccagcgatggcatgagtccacgaagatactcaaatacctgcaccgtcatcacggagtctttctgattcacccggatggggacctggatggtgaattatgacccataaagacgcttgatgttcctgatcatattttttatccctgattccggtatgggaaaccctattgccccggagagggaacagatccgcagatatggacgtaaccctcattgatctgattcttcatattgattcatcacttgagcagatggccggcgaattaggactcctcatctatgccgtcctctttctcatcatcttttgtgagacaggacttgtcgtaaccccgttcctgccaggagattcgcttctcttcgtgtcaggagcccttgccggaaccgggatccttaatatctgggttctgcttcttattatcgggcttgctgcaatcatcggagatacggcaaacttctggatcggcagatatgccgggtgtaagatcatggagggtcggctttctgcattcattcataaagaatggctggaaaagacacatcactactttgagaaatatgggggggcaaccatcgttatcgcacggtttgtcccgattgtcaggacttttgctccgttcctggctgggatcgggaagatgcactaccagtggtttctgttctataatgtcaccggtgcaatactctggaccggagggcttgtcggaggcggatacctgattggaaatattccggtcatatctgaccatgtctcacttctgatgtgggtcgtgctgggaatatgtatcttctcaatagccatggtaataaaagccatcctttcagccgccctctatgacaaaaagaaagaaaaaacaacaggagattctgctgctgactactgttaccgccttgaagtggagaaataacccctgacttcagttcacacgacggatggcagcaggatcaaaggagtgaaataggctcccccatataccatacataccaggttgcctactgctccagtacgggaggaaattgatgagatgtgatcacagacatacacaggatcctgctttttcccggtatgctgctctgacgatgcttccgctcctccgatcattacagcaggagttatcaggagtcaaaacggcagatgatatcgaatatgtccatcgggcacgggttgcaacccgacggctcagggcatgccttaccatattctccccctgcctcccgtctcataatgttaaaagatggagacgcaccatcagaaacattacgaggtcacttggtgaggctcgtgacctggatgtccagactgattttatcagttcatttattgcgaaacaatgcagggactcctgtcagggagaggtattctactattcctccccattagcagacaataaacctgataatgaagggaatgaacgttcgtatcacccgctctttttcagagtgacagaagggaaaaccggtgaggaatccgtatctgagagccttctttcatgcacctcatttgatatacacagaccaggtctggaatgtctgctccaccgattaaaaacccggcgtcaacagatacaaccggatcttgtcagcgccgtcgaccaactggaaaagacagcggttcttgaatcaataacgacctgcctgcatgaactgaaggtcagagcagagattgaggatggtggagacgtttctccattctcctatgaacaggcgtttgtcaatatcatgaccgccatctccgatctcttctggtatgaaccctggcttttagaacctgataatatccatcgtcaccatgagatgcggatcgctgcaaaacgacttagatataccctggagtcgttcgcaggtctgtttgaatgcggattgaaaaccgagattaagacatttaaaaatcttcaggatgttcttggtgacatgcatgactgcgatgtctggattgagaaaatccccctcttcatcagggatgagaagaaacgagcactcaggtattttggaaattctgactttttctctatcctccaggaggggttatataaactccttgataaccggaagaagaaaagggcagaacttttttccgaactgcataccctctgggactcactcaaacaggagggattctgggacgagctgatggaaaaggtatcaattcctgtccatcattcattccaggaacgttcagaccagtgccatgacgggccggttacgattgccctgatatcagatgttcatgcaaatcttcctgcccttgaggcggtacttgctgatgcacggcagaagggtgctacggcagtactcaatgctggtgatagtattggatatggtgcatttcctgacgaggtcatatcatctcttcgttcatcacatgtcctctcggttattggaaattatgaccaggcagtccttgtgaaaaaatggaagacaggaaggcccaggtcacgagacaagcagatcgcgatgcggtttgcataccatcatctctcaaaggagaatcgtgcctacctcgcagggcttccgagggaatatagattgagggtaaaaggaactaccattctggtcacccatggaagccctgattcgcttactgaatatcttgtccaggagacgccggagtcaaggtttcgtgagattgcacaaaagacaaaggcagatattattgtaaccggtcattcccatctcccgtccatcagggagattgataatgtggtatttgtgaactgcgggagtgtcgggagaacagaagatggcgatccccgtgcttgctatgccctgctgacattagacccgctctcaatcgttcatgtacgggtaccgtatgatattgaccgggcaattgatgccatcagaaaccgccaccttcctgattcatttgccaggatcgtctccgaaggaaagcccctggatatcgtatccgaaccggaggattcggtctgatgaagagatcggtctggccggttatccaggactattcagacaggctggacccggatcctcctcatgcacaacaggtatgccggttatcaggtatgttatttgacgatttacgccccctgcaccatctgccccctgatacccgggatttattaaaagcggcagctcttctccacgatattggctggagtatagcagataagccccatcataaagcatcacgggacataatcctcaatgatacaacaatgaacctgacatccagggagagaaagataattgcgttaattgcacgataccaccggaagtctcatccaaggcctgatcatgccgtctttaaagaactctgtgaggatgataagcagattgtttcctggtgctccggcatcctccgggtagctgacgtccttgatcgggcacatcagaatctggtcagagaaattcgctgctttattgcatcagaagagattgtactctcctgtacctgtaaaacctcattctactatgatttaccagtctttgcagagaaaagcatgcttttacaagaacttacccatcgcaggatttgtctttcatgcacctgaatactccacggattattggatttattgatcttgggacgaattccgttcgtcttcttgttgtgagactgaatcagaacggatcatacactctcgttacccagcagaaagaggtaatcagacttggagaaggggaatttactgataaccggctgaccgatgcagccatgcagcgggctacaggtgtaatcgtccggctgattgaacttgcaaaaagcaggggggccgaagaatttgtcgctgttgccacatctgcaacacgggaggcatcaaatggtgaggaactctgcaaccggattgaggaccttaccggtgtgcagattcatatcatctccggggcagaggaggcaaggctgatatggctaggcgtatcaagcgggattgacctaaaaggtgaaacggctctctttatcgatatcgggggtggatcgacagagattatagtcggagatcagcatgaaccgttctttctgagaagtctgaaactgggagctatccgaacaacgggtatgtttgtacaggctgaaaaagatggaagagtatcacagcacatgctcttttctttgagaaggcggattgagcatgagatcgtgcatattgcaaggcacataaacacctggaatatcaccagggcgattggtagttcaggaaccatcctctcccttgaaactgtcgctgcatcacataaaccatgtgtttcgtctcatattcccggttttatcagtatcgaagaactggatattcttatcagatatctctcaaatctgccgctgcacatgcgcaaagaggtcccgggcctgaattctgaccgggcagatataatcatcgcaggggcagttattcttcatgagatagtaaaggtgagcgggctcaaaggagtgtatacgtcatcccgctctcttcgggacggcctgctcgttgattacatcacccggatcccgggctttccccatgcggaacctgtttccatacgggaacgatccgtacggcacctgggccggctctgccatattgatgagcctcatgcttcccatattgtcaaactctctctgcaactctaccactcagggatcagagccggactttttccatcgtatgacgaagcagaagaactcctttcacatgcggcatatctccatgacgtcgggcagtttatctctttttccaaccatcatcagcactccttctatctgataacacaggttccccttcttggttttaaccagcatgaggttctgatgatcggtcttattgcacgatatcaccggaaaaaactaccgcggcaacgggacaatccttttcaggaactggaccggaccgaccggagaatagtcagggttctttctctcctgctcagaattgctgaaaaccttgaccgtagtcatgaccggcgtattgagaaggcggagttcatcaggaaaaaagacagggttgttttatcggtctcctgcatatcagactgctcactggagatatgggccgtcgagtctgaaaaggattcattcttcagaaccttcagaaccaagttacagattgatactcaccgtggataacggaaatcatcagtgttctgacttcagttccccgacaagatcatggactactgttattacatcatctttggcctcttgatctctgagtacttcacctctcttgtacccatgcccgtgtactgacctgattatcttcatctcatgagcctgtgcccatatgcggatggtctccagggcacgatcttctccggagaccgcactgactgcgaccggaatgacctttttgcctttgagctgccggtcatgccagagagaatacgtccggtcgatgaaattttttacacgaccagatacatcctgaaaatacacaggtgagccgatgatgataagatcacttttgagcatttttctggcaatagaattgaaatcatccttcaccacgcaatatccggcctccatgcattttctgcatcccttacagggacctatctttgcaccagccagggacaccgatttcatcttgagatcttcaatggcggcctcttctatctgctcattcagataaccgataagcagaccggtattgcccttcttcacatgacttccggagagagataaaacgcgcatgtatatgaccaggatctgataccatataaaattactggtatccctattttgattacacaatattcccggagtttctatggtttcactatagaataaaatatcacaatatattttttgtttttatacagagagatcgtatacatccctctcatccggtggcaatattgattaccatataaagcacagttcccacagagaggcaggtacggtggcagaattttcagtccttatcggaggaaaagcaggagacggcatctcacaggcaggtcaggttatcggttctgtcttctcctcactgggatatcatgtgtaccagtatgtcgattatccctcgctcatcaggggcgggcataacttctgtatcattcgtgctgcagagtatccggtgacagcattccgatccggggtggatgtcatcatcgcctttgatcagcagactgctgatcttcataaaggccggttgtcagatgacgggatcatcatctctgatgccgaccgggtgaaggcaccaggccttgagataccgcttggccaactgataaacacccaccaggggattccgatcatgggaaataccgctatgatcagtgccctgttcaggtatcttggtgttccatgggacaggatagaaccggtcctgaaaagaaagaatcctaagaaaacagagaaaaatcttgagattgcccgggccgcctgggacatactctcaccatcccggaaactgggtatccccgggggttctccaaaacccttcctttcaggtaatgaatggattggacttggccttctggccggcgggcttgatgcctatgtggcctatccgatgaccccgtcgtcaggcatcctgcattttctcgcttcaattgcagatgaggcagggattcaggtatatcatccggagagtgagatagcagtcatcctcatggcactcgggttttcctatgccggaaagaaggcagcggtcggcacatctggcgggggcttctgtctgatgaccgaaggactctcccttgctgggcaggcagaaattccaatcgtcatcgtcgtctcacaacgaaccggcccatcaaccggactgccgacatataccgcacaatctgacctgatgttcatccgccatgcaggacagggagaatttccccgttggatagcagctcccggaacacctgaagaagcaatctttctcggagcggaggcggttcgtattgcatggaaatttcaggtccctgcatttatcatatccgataaaaccttctcggaggggctctttaccggatcggctgatctgccggacctcccccctcaccgggtctctgctcctgcgtttccctatcaccggtatgaggatatgcctgatggtatctcaccccttcttgcccccccacatcctggtgaggttgtaaaagtaaacagttatacccatgatttcaaaggcatcacaacagaagacccccagataaccattgccatggttgagaagagaaaacgaaaagagctggctttgaaagagtatacagaccagccggagagtataagaattaccgggaatgaaaaagcaccggtatgtgttattgcatggggttctgtccgtggacaggtggcggagattgcaaaagataactcattccggtttgtatcccctcttatcctcgaacccttcccgataaagacctttatggctgctctggagggagttgacaggatcattgtggttgaagagagtgcaacagggcagatagacaaaattctcaaagagcatggtattgtcccagatgagatcatcctgcggtatgacggaagaccttcgacgattgaagaactggaaaccaggatcaggagggtattatgagtccgaacgcaacactggtatctgaagcaaaaaacacctggtgcccggggtgtggaaattttgcaattcagcatgcgtttcgatatgttatcgaagaatatgagaaagagggtattccaaaagagaagtttgtcctggtttcaggcatcggatgtcatgccaaaattgtggattattttaacttaaacagtttttactccctgcatggaaggacaatccctgttgctaccgggattaagatggcaaatcctgatctgaaagtcgtctgttttgctggagacggagacctctatgcagagggacttgatcatctgatccatgcagcaaaacgaaatatcgacattacggttatctgtcataacaaccgggtgtatgggcttactaccggacaatataccccgacatccccgtatggctaccagggccggtccaccccgaacgggatccatgagtacccgctgaatattattgaggtgttgctcgggtcaggggcaggctttgtggcgagggcatactcgcggaatatccccctcctcaaacgggttatacacgaagccatctctcatccagggtttgcccatattgacgtactgcagatctgtgcaaccttctttaacatgacctccgtctatgatgagcaggtatacgaaacatctgaagcaaatgtttcacagtttgatatggcctgccggaccgggcagcaatggaactattctgatccaggaccgatcccgctcggtatcttttacaaaacaattcgcccatcactgccggagaaacgtgagatcaaacagactgaccggaaaaaagtaattcaggagatcctttccagatattcctgattgttatccctgctcttttttcactggccgcttttttataacccccatgacaccgaggataataatggcaatgataccaattccgatcatgagataattcagaacaaatatcgccggaggtatgacaaagggagcgttcatcgccggcatttctatctcctcatgtgtcgtggctttcctgatctctggattcacctttgcaagtctgtttaatgtatcactatacttctgcgggatgtaactttcatccagtgatattgctttttcaaatgcattcagggcatttttcatattgcccatggtaaaatgcacgcttccgaggttattccatacctccgcagaatcaggatagatctgaatagactgattaaatgcagctatggcttcatcattgcggtacatctttgcaagtacctctccctttttattccatgtcgcattatttttcggatctatcttcagagctgaggtatacgcataatccgcctcggtaaaccggtttaaggcagcaagcacatctccatatccgtcctgattctgaaagatatagggatttaaagagacggcccttgtatagatatccagcgcttcctgataatttcccagctcataaatggcacgacctttttttcccaggagatctgcattcgtcttgtcgatggtgatggcgcgatcatatgattcggcagcttctgcataccgcttcagttccatcatcgcatcgccgcgtaatttccacccttctgtgtaatattcatccagaagaagggcctgatcataggctgcgatcgcgcttacataatccttcttttgaaaagcatcttttcccttgtttatccaaaccgtagcgtcctgaatattctgagcaggtacaacaggacagagtacaaacgtggttgccattaagagaaggattgccagaaccatgccttgccatcgggtcataggtaattccatcggtattttactcaaagaatccaatgagagtgtgacggattcaataaagtagtttctctttccaaaagaaaagacctcgttttatcatttcttgaaagagtatagcatctgatagatttcgatccgggatgcaggtctgcatagtttattagatggaacgtgtatgttgttttaggtatcatggagatcgtgaaaatcccccggatggagaaagaagagtatgatgcgctgattcacagccgttttatggcacgaatcgccttttctggggaaaaatatccctatattgcgccattcctctatgtgtatgacggaaaccacctctatttcctctccacaaaatatggcaaaaagatagagtacttcagaaaatccccatacgtctccgtggagattgacaagtatacaaaggatctctcctgttacatgtttgtgacactccagggatatcttgaagaggtgaatgattctatcgagaagaagctcacgagagagagatttgtgaacctgatccgtgagcagaatctctccaccaacattcttgcagccctcggtcactcaccgcaggacccgccggagtcaatctgtaaagaggagcgctcacttgtctggcgcctgaatggtgtcagaaatctcatcgccctgaaaaatatgtaaaccccggagataccgccgtaactcaccgaccgtcgtgatggggggataacactgctggtgtgaacagatgtgaagggcaggtgtgtccccctgacaatggacatacagagggaggaagtatgagtcagatctctccctgatatggattcttatcataccgggaagatacgaggaccagagaaggctccagatctcatcgtctcccgtacttcctgatgtattacagagtacagcagtgcctctcaggtttttctcgataagtccacataaaaaggtgcagcagccggttatcatccggggatccagtgaacgttgatactcctctatctgccgggatttttgaccatataattcatccccggtaatggtaaacaaggcacaaagtagcaggtaggcggctccgttcgttgaaaatgtcgggccgtctgtcatttctttcattcttaccggcagatcagtctctgaggggacttggaaatatccaccgtgtacagaatcatagaaccggtcagatgcgctcttttccagtgatatagctcgccgaagccacagcgaattgcctgttgtctgatagagtgtaacacaggcccatgcaagatggacataatcacctgcagttccttcaataccgccctgaccattccgccaccggtgtagcacactcccgtcaggacggaccatgttcgaaaagagaaattctgctgcagatattgcccttgtgcagagtgattcgtcatgaaagaccataccggcaaaggcaagtgcctggattgcaagggcattccagtcggtcaggaccttgtcatcaaggggcggtctttcccgctctttccgtgcattcgtgagcgtattgagaattgaggcataggttttttccgggtctctgactcccgctgccgataaaatctccaggggatcacgctctgggaagagaacattatctccgggtttcatcccatgcatcccggacacattcccttccctggtgataccaaacatggtgcagacaagccgtgcttcttctccgaagatcttttcaatttcatcatacgaccagagataatatgccccttctccacccggactgtcggcatcttcagatgaggaaaacccgccgggcgcgtcagagaggacagtagtcatgtactcaagaactgagcgagctagcctccggtaccggtcctgttttgtaacctgccagatctcagtatagattatcgcacacatcgcctgatcatagagcatcttctcaaagtgaggtaacttccaggccgtatcggttgcataccggtgaaatcctccgtccagatgatctctcatgccaccccaggccatccggttaagtgtcgtcgtaatcatatcaagaatggaccggtcctgatgtatgaccgcatacctgaggaggaagaggagaacgggaacagaagggaactttggagcaggtgaaaaaccaccatattttttatcgtacaacgcagtgagacgcctggcagcagtgtgaatcagttcatcaggatcatgcagggtgccccgcctggtctgttcctgtatcgctgacataatctggtcagatagatcactgaccttttctctctcatctctccagactgatgccagatatgggaggagatcaagcataccgggcatattcggactgctcattttcgggataaaggtggctgcataaaatggacgtttatcaggagtaagaaagacatgcaggggccatccgccagacccggtcattgcctggcaaacggccatatagacctgatcaatatccggtctctcctctctatccaccttaactgagacaaaatgagtattgagcagtgatgcaaccacctcatcctcaaaacagacggtctccatcacatgacaccagtgacaggcagcatatccaatcgagacaaaaaccggcatatcattctctagtgctctcgcaaatgcctcatcaccccagggataccagtctactggattgtgtgcatgatgacgaagatagggactgtgctcttttaccagcctgtttggggagtgagtcataatgcaggatgcactgtttcaggatttaaacattgaggagaggccacctgatgataacaggcgatggaagcacgtaaaaagatacgatctgaaaacctgcatcctcaataaaccacagaacgattggtttcatttttgagagggcatacattaactatttattatgacatagacaacctctttccatcgatggacaatacccattattacatctcacggatcgctgattttttacgtgagaatcgggatggaatgacaatatctgaaatttcaaccggtttgtccatgtcacggaacaccattgggaaatatatagaaatgatgtttctctccggaatggtggatgtgcgaacggtcggaaaggcgaagatattttttttatccaaacgcatcccgatcacaacacttcttaattacctttcatcttcggttattcagactgatgaccggtattacattcaaagtgcaaatatctctgcagctgaattacttgacaccgaccttactcagatgaccgggcgtaatattctggaccttcttacattacagggtttaaaaccggaggtcaggacaagaatactctccccagaccggtccctggtctttgcttcagatattgaacttgtcaggtcagatcagaaacggtttgtctggctgactgttgcagatgttgtcatgtatgacggagcaaaggggcattatttcgtcattgaagatgtgcatgaatggaaagaggcagaagagagtaagagaagatattatgctctctttcacgctctggcagcagaaaccgatgatcgggtttttgtcatgacgccggaacttgtctttacctatgtaaatccccggttcggacgggcctttcatcgggaaccagagtcattcatcggggagagccggacaaatatctgcgatcatcatgcaaaaccactgattcaggaagctgcaaagtatgtatgcagcagaaatgaaccgtaccggattcttttctcgatacaggagcgggatcaggtcaggtggtttgatgaacgattatttccggttcaggacaataaaggggaagtcagagagatcatcgggttttcacgtgacattaccgggtttcaggaaggaggttctgcctcggttcttcttgcatccctcatggatctgctccatgaagcggtgataaccacaactcctgctggaaaggtcctttcatggaaccggggtgctgaactgatgaccgggtatccccgtgatgagctgatcggcagcacggcactctcaataatcacccctgatttgaatgccggcagagacctggttctggaaacctgtaacggagaggagatacgagatgtaaaggcgattatcagggcaaggggggggagaaagaaaagagttctgatctctacttcccgattgtcttttcaggaaaatatcgtcagtggagtgtgtatcgttattcgggaacattgaatctgtgacgaatgtatcagcttaaccctctttattaggactatcacatgcagagcacatggtatctccatcacggatcagcacacatatcctgcatatccgatcacgtggatcactgatctttcctgatacgagatcccttgccagttcggcgatggcatcagataccttatctgaaaatacaatccggtatcctcgttttccggagagatattgtgatactgccgaaggtgccatgttcaggatagttgccaccatcttctgtgaaagcccgcacctgaccatctctcctgctatcgcggcacgtattgccgggagcgaatcccacactattgtctcacacggaagttttggtactggcctcctttagaactgaacatggtagtttaaaaactcactccaattccaaagatgatcagtaatactttctaacattgctggagacttgtgactactttttacttcgataaaattatgcacaaattgaaagatatttagcgctgaaatgaatctattgagtttttttgaaaaagaggcagttttccttccaaaacggctcaatcgttgtctgattttattattgtagccctcaatgactgaggtagagattgctttactatctggatttcccataattttctctcgaatgacataaacaagtttattcttctcttttactttgatcacctgaccataatccaagcatggctcacaatataattcaggtaaacaaatgctatattggacgtttccatcagtaaaaatcgatattttgttttctggcgttggaagttccattcggttaaaaaatcgaactaacatatctgcacaagtatcaatatttctttttccagattcaaatgctaaaaataatccagaatcccttttaaaacaagtataggaccaacaatcacctaattcttcagagtcagttgttaggagattcttgtttttttttgaacaaactcccaaatttcatccatctcacaatcccccgcggaaatgtcatgaataaaataatcgttgagtttttcagcatgttcaccgattaagtgataatatcgagatatagtgtcgcgatggtgtccggtaactcgagatactcctcgaattgaagttttttcagtcgagtgtttcgcaattatgagaacagcagttcgtggtaaacgagaatcatacagaggagtatttttagtttcaataaaaaaacgtcgacagtgatggcaatagtactgttgattgcctgcagaattatgcccatttttagtaatattctttccatcttcaatttgaaaataagtacaatccggattttgacacgtaatcaatataggaccacgttttccaaccatgaaaataattatatctaaacttatattaatttttagtacataaaatttaatactttatttgcacttagtattaccagcttgctaacagggcactaccgaagtttttccatgtcatatctccggtgagaacatgtttcacgccgtgaattatcaatatgtgtatctggatgacacagaactgcatcgcattgcagtaactatatcggatactaccccaactcattcttatggcaccactccggttatggatactcagctccctgttaatattggcattgacaggtgttgggatctctgaagaactctccaatcaggcagaaccaaccgggtttattcccgatggctatgaagatgacaatcccccgtattatccgactgactacccgaccaattcccccacctatatcccgacagatatacccacagaatatccaactattaccattgaaccaacaccacaggagcagtatggatgggttttaataaactcggtcccgtctggtgccatggtcacctttgatggatcatatcagggtctgagtccggtaacggtgcaggtctcactgactgaatccaggttccatcagatctacatctcaatggacggataccaggactggagcacctccctttcagaactccccgcaccaggccagacaattccggtcaatgcaatccttgtgccgatggaaccgacaataacccctacgtataccccgacctggactcctaccgagacaccaacatggaccccgacgccaacccccactatgatcggttctgattatggatgggtgtatattgagtcagtgccctccggtgctgaagtaacctttgatggtacctaccagggctctgccccggctcttgtcaaagtgtatacgactggcaccccatcacaccagatcctcgtcagaatgaccggatattatgactggacctcgtccctgagagagaatccgcttccggatcagaccatccccattactgccactctggtcccgaaggcacagtatgggagtatccgggtgacgtcacatccgacgaagagtattgcaatccttgatggaggaaaccaggatctgacaccctgcacgttctcagacctgatgcccgggcttcatacaatcaaagttatcaaagacggatatcagccattcatgtcgcaggtccgggtaaacgcaggatcacagtcacaaatccaggctcagctgaatcagataatccagaccggaacactctatgtttccagcactccttccggtgcagacatccagcttgatggcatatactacggacagacaccatataccctctctgcatctgccggcagccatagtctcatgctcaggctggcgggatataacacctggaaatccggtgtaacaatttctgcaggtcagcagaaccagatttcagccagccttgaaccacagggaccgcagttaggggcaatccaggttgcaagcatgcccggatcctcacagattttcctgaatgacaattatgaagggaagacgcccgatatcggatacctggatatccccatgctcaatccgggtatatatgcaatcaggattagccatccccagaaccaggattaccagggaacggttgctgttaatgcaggacaggtgagtacggtcaatgttgccctgcaggcagcacctgttccggcaactgttaatgggaccctgatggtgcaatccaatccttcaggggcagcaatattccttgataacctgtttaaaggggtcacaccactgaaccttccttcagtaccccctggtgagcatgccctgacccttcggataaatggatatgatgatgctgtcaggcaggtcagcataactggtgggaataccacggatgttgttattgagatggtaccgactgcacctttgactcaggaaccgacacagacctctgagccgacgcagacaaagtcacccgcaccaatgtttgcactctgtaccggaatcggccttgctgcagtagctctcgtattgtcccgacgatctgatcggtgagaagaactatcccttttttttacctatagtaccagtgtgaagcatccgatcacgctcatatgcatcatcatcctactcgggttaggtagcatggttctggcagaagaggatgatgtcacgaattcatcacccgtgattttttccttttccgctgcaagtcccgtgaaggaagcccagatcaatttcacgctcaataccaccagtcattactcaaaaaacgagtcaattgaagcgtattataataacctcagcatggaaaccgacacaagccttccaaaattagtgctgcttgggataccaatggaatgtcatttctgtatgataatcccatcagtcattcttacagggtagtcagcagagctatccatcaccacgaacaatatcatataccacgtgaaaccggtccggagaataggatctgacataccggtgttcgacgttttttgcaggaaatgtccgtagagtatcaatatattcatcctcccggctcaccagggcatacaggtgtatcgtaccacccggccgtgtcatcctgaacgctgctgtaagaaacgggatcgaatggaggggcaggttcatgataatccggtctgcagggtgcataatgatgtcaggaagattgatggcatccgaaaggatgggaacgacattggtcaggcggtttcgtgcaatatttctgaccatgagaatgactgcttcaggattgatatctcccgcatagacaatggaggctttttttgcaaggggtatcgcaaaaggcccgaccccggcaaacatgtcaatgacacgctctccttcattcatcagtgagagaatacgctggcgttcgccggacagacgggccgagaagtacgcgagagcgagatcaatggagaaatgatgaccatattcgatgtattcagtcgctgtggtatctcttccggcaagcactttgaacttttttgtccggaacggcccttcaaccgcactctccgcaaacagaacggtatgatacgtcttttttgacgcaagaatatcagcggcaccagagggatcatcatcctgcataatggcaattccacctacctgttcaaaccgggggagatcttttttctcctgttcacaggtgaattcctgacaaaccgcgccctcaatttttctgataaccgggatgagcagatactccccatccgacctgatccgacacagacgatcaagcaccccctcttcaagaagcctttttctggtcttctccccttctgaccggtgcacctgaaggcaccagcgttttgtctgcatccctcatgtgttatggccgggccggtataacaggtatgcatggatgagtacctccgcagactgcgggatggaacactgaaattatatgcgcttgagaaagaacttgcccccgctgatgctgtttccatccgccggaagtttatcgaagaagagaccggagttccgcttgaccggattggtgactgtaccatctctcttgacgcagtggtaaagaagaactgcgagaatatgattggcacgatccaggtaccactcggggttgcaggacctgtcaggataaaaggagagtatgcagacggaacgatgtatctcccgcttgcaaccacagaaggggcacttattgcatcagtgaaccggggctgcagccttattacagcagcaggaggagccgatgtcagaatattaaaggacggtatgacccgtgcccccgtttttgctgctgacagcattgtccatgcaaaggccgtgtgtgactggatacatgctcatgagggagagatcagggcggaggccgagtccacgacccggttcgggaaactgaccgggatagagatgacaaccgcaggaacatctgtttttgtcagactctcctttgttaccggcgatgcaatggggatgaatatggttaccatcgcatcagcaaaagcagcagatcttatcagccgggagaccggggcacgccttatcgccctgtccggtaactggtgcacagataaaaagccggcagcggtaaacgttgtcatggggaggggcaagaccgtcagtgccggagttttactctcccaggaactgataagcaaggtattaaagaccgatgcagcctccctccttgaagtcaataccagaaagaatctggttggatcagcccgtgccggttcattcgggttcaatgctcatgcagcaaatatcattgcagcgatgtttattgcctgtggacaggatcctgcccatgtggtggagggatcactctgtataaccaccgtggatccagctcatgagggggtctatgtttcggtcacactcccggctcttccaattgggacagtcgggggcggaaccagtgttgaaacccaggcagagtgcctccggatgcttggcgtatccggcagtggtgacccgcccggctcacatgccagaaagttagcagagatcgttgcatctggtgttcttgccggagaattatccctccttggagcactcgcggctcagcaccttgcccgtgcccacagtactctcggaagataatctgtattaacctctatctcagcaactctttcttttcatatggtacaccctatcatatgacagattacgggtgtatcagacaccctgcattatgcaggatttttctgtttggtcttctcattgcaggacttgttctgtgcatgattccgacggtgagtgcggattttcctgagacacactcatggaacccatacgagggatgggatattgaactttcatcagtagcaggaatcggactatttccaactgtagaggttgactggacgccaaaaccaacagcaggacctctcccgaaagtatccagcgacacctgggtgaaactggcctactatccgcccggaactgaggcaggtcaacccgcaattcttgcaggatatgtgggtggcaggaactacaatgcagaggttaccatcaccggcaagatgaaggccgatgatgaatttcatgatattgtaaccactaaagcccaggagaatggtgtttttgtctgggcggtaccagatgaactgaaatcagtaccctacttccaggctgttgcgaaagtaagtggggcgatggcaaaatcagagattgtccagaccagcgggctttccgggtatgttccggctgagtcatctgttccgacatcaccatcacccgggcctgtcattgcagcctcaacacaggtacctgcaccggcatctgaccttccaaagattaccagcatgactctttctgcgaataacctccgccccacagtgggaacagacgtggagctcaccggccggcttgttgatagttcaggaaaaggagtgcctggtgtcagcatcacaatagaggtcccggattatggaactgatttcctgccgctgcttaccacgtctaccgatggtgatggacgattctctgcaaccatcagtacctgggaaggcggaggcgttccggtcagggcagtatttgaaggaaatgataaatatcttgcctgtaccagtaacactctgacgttttacgcatcagataaaaaatccacaggtttaaccggtggcgggacaacactctaaaacgataaataaaccttttttacggatttaaaaatccgacatcagggaatggcacggtctgatccagaagcagaaagacgatctgcgggacgaagagcagaattacaaccagcactctgagtggcgcatgctctatcttccggtaggcatatatagtaaccacgagcaggagcatcattgccaggatccacatgtatgtatatggggcagcttttcccagacttatcgtgagcactgcatagctgaccagcgaagtaaaagccatggttccgcatacaagtgcaactattgcgaagaataactctaccagtatcagcgctctgttccgggcagtcacgatgaatcattcccgctctttttataaaataattgtgatgagttcttcatttaccccatgatattggaactgactttgattaccttggcttccacctcagcctgtcgttcacctgatgagagttttctgaaattatcaggtgtcatctgaagtgacagcgttctttttaccgatatcgtgctgcgtttttcaaccgtaccgaccggaatattctcatgaataaaccggtactcagggaggtcctttggtgtacttacaagagccatgatctcaacatcatatgcattatttcccccggcattctctatatcaaggctgacctcataggtgatggtattcgtttcaggcgatatattcacctgctgtatggcagggacgatattgagttcaggaggagcataactgctacatccggcacacaggacaaacccggcaaatagaataaatattgatacaatgaggattcgtttcatgattcgcgccccagttctgtaatctttacttcagcttcagccagccggtcctcacattgcctgaccagaatcatcccctgttcatacagggtaatcatctcatcaagactcgtgttgccgtcttccatctttcgtacaatctcttttaactcgcctatcagttcttcatacttttttgtcatgatacacctgcgttattgctgcatctgcggttccatccctcagtcgtatcgtcaccatcttaccaggggtaagttcagtacaggatctgattaccgtccctgctgaactgaccatgcagtacccggcctgaaagagggcttcaggaccccgtgctttgagaatggcagacaatgatgtgagttcggcacgctctgcctgaagtctgacctgaactgcacaggaaagccgcccctttatttcagcaaggaaattttttcgttccggaagttcgcgcctgagatacaccagcgggtttctcccctcaaggcggccacgaagttcagcaagtctggattgtgctctatcttttaatccctgagctccccgttccatgcggtcggtcagatctgcgagagcctcctgccgcatccttacttcacgaagtaatcgtggggaggagaggcgatctctgatcccattcaggtcttcctgtgctgattccagccggttcatgagctgtaaaaacatccgctttctcatatgtatgagggcatcgagctcactctcccggtcgggtacgcactgctctgctgcatgtgagggggtagaggcactcacatcagcggcaaggtcggcaagcgtgatatccacttcatgaccgattgcggcaatcaccggcaccgggcacgtgacgatggcttcgaccacacaggggtgattgaatgcgaagagatcctcataactccctcctccccgaccgacgatgataacatccaccatatcctgtaccctgatgattgcccgggcgatctcctcatgagcagatgctccctgcaccatggttggtgaaaggattatttcagcaggaaaccgcttcgagatgacattcctgatgtcatggatcaccgcaccagtcgaggaggtgactactccaatcctgaccggatacctcggtggaatgcgttttctatcagggctgaaccatcctttcgcggccatctcacgcctccacccctcaattaggagtgcccgctctccggcacctgacggcctcatctgggttatctgaaaggagtaccggcctcctggttcataatgagagatagagccataggcacggacctccatcccgtcatcgggtgtaaaatccaggtatcgtgcggcacttttccatatggcacatgaaaccacagactcctttccggcaatctgttcggacagggagaaatagagatgaccagaactgtgtctcttaaaattggtaatctccccgattatccagatattctgcagggatggatcctccaggagccgggtaatcattctggagacttctgaaacccggagtgtcacggggccgtcctttttcgtccagttgtcgagtgttgcctggtccatgatcacctgatcgattatcttcatccggatagataatgtctggtaatggatatttcgttctcaagtatgttctttcatgatgcacctcttgaggatatctttcgttcccctgaacaatcaggggcagactgcctagagttctggcttgaaacgcctgacttctggctgaaaggtctctgtcttgatgaattgaaaagacaggtaaaagccagtccgaccagatctcctctgtcagttcatgcaccggtacttgacctgaatccctgctcaatcaacccggatgtgcgggaagtctcaatcaggtggattgaacgatcaatcgaacttgctgagcagatcgaagcatctgtctgcaccatccatcctggtcggagaacagcaaaacggcctccgagtatcaccgattatcaacggctcggttttatgcttgaccggattgaacggattgcagacgaggtcagggtgaagatcgccatagagaatatggagcctgcagtaaatgccctgctgaccactccggatgagataataaaagttctggatgagcgatcctggctctatttcacctttgattatgcgcatgcggttgggagcggacctcaggtggtctcgtcctttcttgatggaggtgccggaaaaatagtaaatatccatatttcaggagcaggaaatggacagatgcatggtccggtcagctcagatgaaaatgccactcctttccttagagagctcagggataacaggtatgacgggcagataacccttgagatcaatgacctggttctgccatcggcattatcataccaggaaaaaatttcgttgctgaagcaggagatagcagtgataagaaaagcgttcaaaggggaggtggaattgacaggggcgatatgaatcatattataatgaatattctgtcagtgctggagtatacctgtttcattgtgagatcagggggtatctttttgtctctggttacaatatcatgtaggaacagtgaggcagaggtataatctgtcaggtcatacctctcataccacaattgtctatgccgtattccggcgtgatcgctgaatgatagaatactacctttatataatcatcttcatattatgcctcattttatccggttttttctccggatcggaggtggcattgttctcaattacgagagccaaagtcagaactcttgtcaacgaaaaagaaccaggatcagaagctcttgctaccctgaaaaaaaatccggaccgctttctcatcaccatccttatcgggaacaatattgtcaatattcttgcggcatcagtcgcaaccgcagtggcaatcggatttcttggagagacgggcattgctgtcacagtatcaaccatcattgtggtattactgctgcttgtgtttggagagatttggcccaagatgtatgcatccaggaatgcaaccagtttttcattacggttttcgccgatcattctatttttatcccggatcttctccccggtaattttcatatttaataaaatagccgggaagatgaccatggccggagcttttgcccaccatatgataacagaagaagagatcaaggaatggattgatgtaggacaagaagaaggaacgatagagaaggatgaacaggagatgcttcattcagtctttgagttctctgatacccgtgtgcgcgaagttatgacaccccggattgatgtcgttatgcttgaggatacatccagctctgatgaagccttggagatctttaaaaataccggattttcgcgtctgccaatatggcatgggaatatcgatactatcaaggggattctgaatgtcaaagatgccatcttctcagtccttgagacgcatgaatccattcctatcgtagaactcctgtctgaaccactctttgttcctgaaacaaagaatattgatgatcttcttcgggagttacgggcgaaaaagacccatatggccattgtccttgatgagtatgggagctttgtagggattgtgaccgtggaagatatccttgaggaactcgtaggggatatccttgatgagtttgataccgaagagcacgaacttgtcagagtggcagaggatgtctactcagttgatgcacgcatgtgggtggaggacctgaacaagcacttggatctgcatctgccaacgagtgagacgtatgaaaccattgcaggtcttgtcattgaacggctcggtaatatcccccggattggggatgtatgtgacctgaccgaagagggagttcgcctggtgattatccagatgaccggaaaacgaatcaaccgcctgaaacttatcaggatacacccgccagaaccctctgatgaacaggagatgacaggttgaaccagggaaggtttgtagtccttgcatcaggcaggggatccaattttcaggcgatcatcgaccgagtacatgatggatatatcaatgctgaatgttccgggctgatcactgacaacccggatgcatatgcgataaagcgagctcataatgcgggaattcctgcggaggtcgtcccgtaccgtaattttccggataaaatccagtatgagaatgccctcatggaagttcttgcgcggtataatcctgacctcgtggtgctggccggttacatgcggcttctcggtgagcggatcgttgatgcatacaccgggaagatgatgaacattcatccatctcttctccctgcatttcagggtcttcatgcgcagagacaggccctgacctacggaacaaaggtagccggatgcaccgtccactttgtcacccatgacatggatgccggaccggtgatcatacaacggacagtcccggtccttgatgatgatgacgaggagacactcgctgaccggatccttgttgaggagcatcaggcatatgcagaggccatcaaactcttttttgaaaagaggctccggattgagggtcggagagtacggattcttcccgattcatgagcaggaaggggacgcgttcagatagaaagcatattgccatggaacggatctccatcctgttctcccaggcagaatctttcttttcttggaaccaggaatacagtcaccactgtgtcagatccgcccgcctgatagccatgaaggagcgggtaagaatccccccatggctgagaagaagatattgcagaagatgtaatgcatacctggtacccggtgtaaccggacgagtgagaatataccggggaagggtgatcatcacctgtcttacctgtggctggcatcgaagaataccaactaccaggagtaccactaccaatggaaaagaaaagaagtgattcgggatttcatgacctgaaacccacgatatggatcggcaaacagggcatgagcgataccatactggacgagatacaaaaccagatcaaagtcagaaaagtcattaaagtgaagtggctttccagtgttgagatagatcctgaatcggttgcagcacaaagcaggacaaaactccttcaggtccgcggaagaacgatggtacttggagattccaaactctaccagtgatcgaaacctcgaaatatatatgtacactccacgcgaataagtagagactacgatccgtattgagagtgtggactatcgatgactactgtatatgatgttccggccgacaagctcatcgcgaaagcggcaatggaactgaaggaaaaagccgaaataaccgcgcctgaatgggcaccatttgtaaaaaccggtacacaccgtgagatgcctccggaagatcctgagtggtggtatacccgtgcagcagcagttctcaggcgtgtatatgttgatggaccggtcggtgttgagagaatgcgttcggtttatggcggtaagaaagaccgtggttccaagccgagcaagtcggtaaaaggaagcggctctatcctccgtaaatcactgcagcagcttgaagcagcgggatttgttgcaaaacagaagaacggaagagtcattacccctgcaggcgcttcattccttgatgggatcgcctataccgtcagcaaagagaaccagtaaacaggagtggtgaaacagatggctgaagatgaactggctgagatccgccggagaaaaatggcagagatgcagcagcacgctgcaatgcaacaacaggatatggagcgtcagcagcagtacgaagctcagatgcagatggcactcatgcagattcttgagccggaagccagggaaagactcaataccatcaaactcaccaaaccggattttgccagggctgttgagcaacaactggtaatgcttgcacaaagtggcagaatcaagaacaaaatatcagatgatcagctgaaggtcatcctccagcaggtgaccccggcgaaacgggaattcaatatcaggcggaagggatgagggcagccgtcctcttttcaggtggaaaggacagctcgcttgctgccattctcctctccacctggtacgaggtcgaactgaatacctatctcttcagccaggatacgaacatcgacgcggtcaggaaagccgcaggatcactcggttttccgcaccatatccgccagttcagggaagaactccttggtgaaatggtagatctcatcatcagggaaggatttccaaataatgcaatccagcaggttcaccgtgaggctatccggtgtttatgcgatgagtatgaagtgattgcagacggaaccaggtttggtgaccgtgtccccctcctcaccgatgatgagattcgaagtatcggggaccggtacggatgctcctatatcaggcccctgattggatttccaaaaaaagaggttgaacgactggtttcccgacacctgatcatcacaaacggagtaaccggtgagatagagaacggggattatgaaaccgggattcggagagaactcgtacgaagaggtctttctcctgaatcattcttcccgcctgcacaccagcagtcgcttgtcaccgggagaaaaaccaattcataggtgtatcatgagcaaactgacaaaatgccgtaagattcggttatcaaaaaagaccacacagaaccgccgggttccccagtgggttatggtaaagacagccagagcagtaatggcccatccacagcgtcacagctggcggcggagcacccttaaggtgtgagagatatggtagagaaacttcaggaacagatgtatgtgattcccctcgggggagtgaagagagtaccgagatggcgccggagtgcaaaggcgatgaaggatatccgtgcattcttaagccgtcatatgaagagtgatgatgtccgccttggccaggatatcaatgagaaagtctggtccaggggtacagaaaagcctcctgcacgggtccgcgtccgggctatgaagctcgaagacgggcatgtacaggcagagctggctgaggagtagatggaccgttttgtctcgatagccggcgatccccatataggcgttttcacccgcgtatttgatgatatcgcggttgttccaccagatgtacctgaagaggttaccaccaggtacgaagaggcattaaaggttgaaattgtcaggaccaccatccagagaagtccgatcattggttcacttctggtcggaaacaataacggactggtaatcacgggaatggcaaccgaagaagaaatagcaaccctctcagaatatcgtgacctgatgctgctggaagagggtatgaatgctgccgggaatattattctggcaaacgatcactttgcggctgttcatcctgaaatggatgaggagttcatggatgccttgagtgactttctgaaagttccggtcattcccctgacccttggtgatgtcaagacagtcgggatggcggcagtcgcaacgaattcaggtgttgttgtcagtccccggactacccctggagaaatacagagactggaacaggtatgttccctgcctgtcgggaaagggactgttaccatggggaatgcaatggtcgggacaggcctcgttgcaaaccgttacgggtatctggccggagtcgggacaagcggatatgaactcggcagaattgaagacattttaggttttgaggaggaataaagatggatgagaagaaattcgaagtaaaaggaacgtaccaggagaagcgtgacttctggaaaccatatacaaaagttctctctgcaccaaatgccacccaggcaaaagagcggatttttgcaatcattggaagcaaacaccgccttgcacgtccttacatcaaggttgaatctatctccgaactgagtggagagtgatacccgtggctgcccccgttgaccccagggaagttcagtctcttcagacctatctgaaccagtacacccagcaggcagaggtatactccaggcagcttgggatgatggaagaaggtattcgtgaggcaaacgcttcaattgagacgctgaaggcccttgcagaggcaggggaagcaccggtattcatgccgataggtggcggactgaatatcagggctaccatcattcagccagatgaggtctttgtcagtattggctcggatatcattgttcagaagacgaatgaaggtgcaatatcgtacctgcaggaccggattaaggagatggaggcaacagccaagaatctgactgaggtgctgcagaagattgatgcacaggtaaaagacattcagaaacgtcttgaacaattataccgacaggcccaggctgaacaacagggtgcaggttccctctgaactcctgccttttgtttggcagcaggtgacggaacatgttcaaagcactgaaagaaaaactcttttctgccagaaaaaaactggaacattctatcgaagtaaacactccggcccagaatgaaaaacctcagggcatatccagagcagagcagatacaccctcagcaggaagtagagacccctgctcctgaacaggtgaagaaggcttccccaaagatcactgataagatcgtctcttttgtcagggatcgtgagtttatcatctctgaaaaggatgtcaatgatatccttgatgagcttgagatggggctgctcgagagtgatgtagccttttctgtaactgaagcgattcttgcaagaattaaggctgatctctccggatcgaaacggaagataggaacatccgttgactcgatcgtccggaacgcactatctgatgcacttcttggagtccttggagaaggggttgatatctgtgcatttatcagggagcatgaacgtccggtcaagattctcttcaccggcgtaaatggcacaggaaagaccacctcgattgcaaaagtcacccggtttttacagaaaaacggattttctgttgttcttggtgccggggatacctttcgggccggtgccatcgaacagatagatgttcatggtgagcggcttggagtgaaggtcattcagcaccaggagggatcagatccgaccgccgtcctctttgatacagtggaatatgcccgggcacataagattgatgtggttcttggtgataccgccggacggttccataaccgggcaaacctgatgaaccaactggcaaagatacggagagttattaatcctgacctcatcgtgtatgttgatgaggcagttgccggaaatgatgccgtcatccgtgctgaagagtttgcaaaatctgtcgggatggatgccatcatgctcaccaaagtcgatatggatccaaaaggaggggctgcaatatctgttgcatatgccgttggaaaacctctcctctttatcggaaccggacaggggtatgatgatgtcatggcattcaacccccgtcttgttgttgctgacctgctgggtgatgcataatgcttgacaacctgggatcgaacctgaaggatgcattgcgaaaacttgccggcaagaccgttattgaccgggctgcagtggaagaactggttaaggatctccagcgggcgctgcttcaggcggatgtgaacgtcaagcaggtgatgcaactctcacagactatcaaaaagcgggccctcgatgagcagccgccaaaaggtgttaccgcacgggaacatgttctccggatcgtttatgaggaactggtcgcccttgtcggtcagaaggttgaggtaacccttggaaagcagatcatcctgatggccggtctgcaaggttcaggtaagaccacaacgactgcaaaactagcccggtttttcaagcgaaaggggatgcgggttgcagtcatctgtgccgataccttccgtcctggtgcctacactcagataaaaaccctctgtgataaggtacatgttccctgttatggcgatccatctgaacatgatgccagaaagatcgtcagggaaggccttgcccagctgaaggaagaggtcatcattgttgatacccagggtcgtcatgcccttgaagatgatcttataaccgagatcatcgacctgaacgagattaccaaggcaacacaccggtggttggttctggatgctgcacttggtcagcaggcacgcgaacaggccaggcgctttcacgaggcggtctccattgacggtgtcatcatcaccaagatggacggtaccgcaaaaggtggtggtgctatgtcggcagttgccgagaccggatccggtatcgtctttatcggtcagggtgagacaattgaggatcttgagtggtttgatccgaacagctacatctcccgacttcttggcatgggtgatctcaaggctcttgccgagcgggttcaggagtcgatcgatgagcaggacatcgatgtgaatgccatgctctccggcaagttcacactccgggatatgtaccgccagcttgaagcggtcaataagatggggccgttaaaacaggtcctttccatgctgccactcggcgggatggatctccccaccgaagcgcttgatgtgaccgcttcaaagatgggtaagtaccgggttatcatggactcgatgaccgcgactgaacttgatgacccaaccgtcctgaatggatcacgtatccagcggatcgcacagggtgcaggtgcccagcttgaagaagtccgtgagttgatcaaatactataagatgatgaagcggacattcaaaggcctgaagggaggagaaaagggaatgcagcgactgatgaagaagtttgggaaaatgggctgatgacatcctttaccgtcatcggccataccgcatgtacagatgcatcgttcccgcttgatgatcttcccggaaaaggggggcgaatggacctcctctgccgggccgtcgcatcctccctttttttgtctcatggcatccgtgaggataccacctgtgatatcatgcttcttggtcagccgcatcctggccggattatccggtttgatggctcagcactcagaagcctctctcctgatgaacggaatatcgcgtcgtcaattaagagagcattagcgatccctgccggaaaaaccttccgcgaagcaggaccaggtcttctgaccagaaaaggaaccttggcagaccagctttcagagaaacattatgccgttcttgatgagtccggagttgatatcaggaaggtggccactgaagaactgcctgatgcatttctcctctcagataaccggaacttttcagatgacgagatggaacttataagggatatccccaaatattctctcggaccggctattgtgcatgcagaccatgcgattgttcttatcctcaatgaaatcgaccgaaggagatcaggatggatctgactgaattataccagaaagtaatagaatatggagatatttgtgaccactgtcttggtcggatggtcgcgaaacgatcctttggcctctcaaacgatcagagagggaaaggcatccggattgcagctgcactgactttgaaccagccatatcaggaacagaaggaaccctgctggatttgtggagacttttttaagtccgcagatgcatgggctgaccgggtcattgacgcattttcaggcattgaaggaaagacatttgtcatcggatcaaaggttcctcccctcatgagtgagtctgaagagatggtgtggagtgatctcgtcctctctgatcctgaaccactcaaatctgagataaaccgtgaggtaggaaaacgtgttgcagcaaaatcctcccttgttggtgatacgaagaacccggatctgattgcagtcctcaacatcagtgatggcaccattgaggtacagattcgtccgctctttctctatggaagatattttaaatacgaacgggggatcccccagactcattgggcatgcagagcctgtaagggcgccgggtgtgaagcgtgtgacgggaccggaaaacagtaccgggactcggtggaagaactcatcggtgcacctctgctccccatttttaaggcagaacgggtgtttcttcacggcgcaggacgagaagacatcgatgcgataatggtagggtcaggaaggccgtttatcctggagattgtgaatccccggatcagggatgctgatccaaaagccctcgaagatgccattaataagtataatgaaggccgggtaggagtaactgacatcagatggagtgcccgatcagaggtggaaaccttaaagagtcacaaagggcataaaaaatacaggattctggtcgatatagacggttccgtcccggatactgcccttcaatcagccgtacagcaactatcgggggctttaattcgtcagcgcacgccgacacgagtagcccaccggagagcagataaagtacgtgaacggggcgttctcgatatcagatatacaggaaaagagggaaaggacttcgtacttgaggtcaccggtgaagccggcctgtatattaaggagctgatatccggtgaccagggacggacgacgcctagtctgacagaggtcctgaacactcctgcacgtgttgtacagctcgatgtcattcacgtagaaggaatagatcaggtgaaatctcatggcacttcataacggtccacgaaaaaagactcggtataaattcaagaaagatctcagatcacgtggtgttcttccggtaacccgggtcatccagcagtttgaactaggacaaaaggttcatatcgtttgtgaaccgagcattcagaaaggaatgcctcaccgcagattccatggcaagaccggctcagtagtcggtcagcggggccgtgcctggctggttgagatccgtgacggtaacaaattcaaaacggtcatctcacgcccccagcaccttcgtgcacagcagttctaaaggaaatagaggaagattggcatgaagataaaaggaatcctgcaggaaaaagcaattactctccccgaattgaaagaagagctcctgaatgtggaagctgcacgacttgaaaagggcaaagagatgtcatatgagcttcggcgcagtattgaacatgccaatcagatctcaaaaacatctgcagagaaatccaaggaactcgtgcaggcactactgcagctggataaggtaaaacctgacgtggcataccgcattgcaaatgttatgccacggacacgggatgaagtgcgggcagtatttggcagggataaattttctcacacccccgaagaactcgatgcaatcattgatctggtgatttctcacttcagataggctggtactcatgaaagaggaaaaaaaagagatcaatgcagtagttctggatatccttcccaaaggataccctgatgatcccagaccgatgtataaaagggagccggttgttcaggcagtcggtgtagaacagttcaaacttcttgaactgatcccaaaaaacctgactcttgacatcggtgaactggtttacatcgggggtggagagcggcccaagatcgaacgggtgaagcgtcgactcaggtacgatgaactgacccatagtgcagttcaggagctctcttttgcaattgaacggatagtaaaggatcgggagaaagactttgtcgacttttacaaccgtgcaattccgatcactccgaaactgcatatgctccacctgctccccggtatcgggaagaaactgatgtgggagatcatcgaagagcgcgagaagaaacaatttgatagctttgcagatatatctcaaagaatcaaaaccatcccgcaccctgatcggatgatcctgaacaggatactggaagagattcaggatccgaacgtaaaatatcatctctttacgtcacgatgagagcataccgggaccagcattttctgactgatccccggattgttgcccggatagcagatatacttgacatttccggccggattgtccttgagataggtccgggcgaaggcattttaacagaggcccttcttgaacggggtgccagagtcatatctgttgaacttgacagaacccttatcgaacgattatcacggcggtttgcatctgaaattgcagacggatctcttacattactccagggggatgccgtaaaggtgccgctcccgccatttgagatcgttatggcaaaccttccgtattccatatcttctcccataactttccggctgctggacatcggttttgaagctgcaatacttatgtaccagaaagagtttgcagaccggatgatggcccatccggggacccgtgactgtgggagactttctattatgctccagacctatgcacgggcgaaccggtgctttgatcttccacccggagctttctctccaccgcctgccgtcaggtcaacggtcatgtggattgaacccagagaaccattattcccgattcatgaccggaagatatatgaagacctcgtccgcgaacttttcaccaggcggagaaagacagtgcagtccaccctgaaagcactggcagggatgtttggaaaagagaagattgattcggtcgtcagggatctaaatccggaaattctctcatcacgaccagaggcactctaccttgaagactttgccaccatctccaaccagctcagttcctgatgaggggcagatatacccgcccagagaagataccttttttctgctcagaatggctcaggcggaggtaaaaccagatgatatcgtccttgaagtggggaccgggagcgggtatgttgcctcatccattcaggactgccggatggtctttgcaaccgacataaaccctcatgccgtgctctctgctcatgaaagaggaatccaggttgtaagaacagaccttatcgcaggacttcgccggattttttctcttattctctttaatcccccatacatacctacgagacctgatgaacgatgccacgactggcttgagtatgcccttgacggagggccggacgggagaggaccacttacccggtttcttgatcaggttgccgatgttctgatacccggtgggcgggttttgattgtaatctcctcactccagtattttgaaaaatgcgaggagatctttaaaaaaaccgggttttcatatactatcgccgatcatgagatccttgaagatggcgaggaactgagaatataccgcctgaaaagagattgaggagattattgcatattggtataccggtgcataatctcttcaatggaacaatgtttcatctcaatcagggcactgataacagaatctgcaaatatcatggcagtagtctcaaacagggttccgaggggggtacaggcagctgatattgaccggtgttcaccacggagctgcctgaggtcaaaatgatcaggaccgacatggcaactctcttcttcggtatccaaaagaaccacgcaatccgcaagctctgccattggtgagaccctggtcccggttatcagacagatctgaccgcctatctgacgggtggtctcacatgcctccatgactgattttgtctttcctgagccggaaaatgcaatgagggtgtcattcttgtgaaatgagggggtgacggtctctcctaccacataggaggtcaggcccagatgcatcaggcgcattgcaaaggattttgctacaaaccctgaccggccggcaccgatgacaaatatccggtctgccgacatcaatgcagatataaaacaatcaacctgatcctgcctgagagtctcggcaatctcaccgatgcgggagatcatcatggacatgatatcccggagggggatacatggttcagttgtggatggtgaagacatgaaatatgcaatattttttttggttttggaagttcatgttcctttgcttaatgtctgaaatacctgattccggtaaagaccattgccatcttcctccggtttgcctcagcaatgacttcgttgtcccggattgatcctcctggctggataagggcggtggcccctgcttcggcggcgacttcaagggtatcagaaaatgggaggaatgcatctgatgcaacaacagaacccttcaaggagaactgcgccttcgagatggctatctttgcactgtcaactctgctcatctggccggcaccaatgccaagggccctgtttttatctgcaaagatgatagcgttacttttcacatgcttacagaccttcatggcaagcatcatcgccgcctcttcatcagcggtcggatcccggtcagttaccacccgccattcctctctctgaaccggtgtcacctgaacgagagcaccaccatcaatggttcttatcgctgcatgtcctgcaggatcggtgagatgaagaagccggaggttttccttggtcttaagaatctctctcgcctcttcagagaaagatggggcaacaagcacttctataaaggtcgaggctatctctttggctagatctggggtaacctcccggttaaccgctacaatgccaccatacgcggagacggggtccacatccctggctgcaatatagacatcgcggatgatctccccggtcgcaaccccgcagggattattatgtttgacaataactgctgcacattcatcaaattcacggagaagcccgactgcagcatcgacgtcaagataattattatatgacatggctttcccctggagcggaagactgccaccaatcccactctcaccatagactgcagcaatctgatgagggttttcaccataccgcagcatccggccattcctgaactgaaccgaatagacagaaggcaactcttcttcaagaccatacagatagttgctgatggctccgtcataagcggccatacgtgcaaagactttcctggcataggcaagtcgctcttccttggagaatgactttttagatgatacagcattcatgagagcaggataatctgccggatcaatcacgacaaggacatcctgaaaatttttagctgcagcacgtatcattgccggcccgccaatatcgatgaattcaatcagttcatcgaggggaagagactgctttgtcatctcctcaaagggatagagattgaccacgacgagatctatcggcccgatattgtgctctttcattatggcatcgtcagtacctctccggccgagaatccctccatgaattttcgggtgtaatgtcttgacccgcccgtccatcatctcaggaaacccggtatattctgatacttcgatgatgggaatgtttgaggcagtgagtacttttgcggttcccccggagctcaaaagttcaatcccggcctggtgcaacgtccgggcaaggtcgatgatgccgtccttgttccagactgaaaggagtgcacgcttcatgtagtactacgtgagtcatcaggtataatgaggatactgggacatccggtctgacgaccagaaccggatcaaaatcaaaaaagttgggatatttgtattatcttctttttgctgccatcgtcatcatcactgccacaagagaaagaaggcagactacaacgccaagcggctgtttttgtgctgatggtttttctttgggtggagagggaagcggaggtttcgtcggttttgcggtcacatcgatagaggactgagtgatgattggagtaatatcaagggtcagttctggaaccggtgtttcagtcggagtaggggtcggtgtcggggtgggaatatcggtttctttctctgaattatctgaatcagtatcttcagattcagttccggattttttatctgaaccatctttctctgactccttctccttttctggttttatcttgcttaacacaaaggtcgttttcagactggttgtcacgccgtcacctgagttcttctcggcgatatcatttgccagaatggtggcccatgcggtatattctccttcaggatacttgtcatcatccttagtttcccagactgcaccggtatcaaagggactatagtagatgaatattttctctaaattatatgtcccggttggtgactgaagcgtcgtgaatgtcgtctcattcggaccggtcagattaatcctgactggaactcctgctgaacctggccgctcctgtaacagatacatattggatgatatcttaaatgaaacgaggttcccctttttgatccattccggctcgtgatcaatcccctgctctaccacatcaagctgaatccagggatcttcaaccttgaacacgggttttttactgatgagcccgtaccatgttccggttttaccggaaaagaatgcaggatccacaaaaaaatgccgggtatccattactttcgcacgggagtcaggtgttccctcaggggagcctgaactccagaatgcgatctcatccccggccctgacattacaatctgatatatcaaggtcattttctccgacaaataccgtcccttcctttggaatttttgaatccagtgcatatgccccggtcccgaagagcagaagagtgagtatgagtatcaggaaaaatctggacaaatccataataaagtatcattttcgctttttttagatatttgcgtgctgaaggactttggtaaggcgagagcatcatattccatgaaggaagagtactatcacgcagttcgctcttgttattctgggtcttgtctttgtcctgattgcaatccgtcaggtcggccggttttccttctcgatatggcaggttatgctggccggggcagttctgactcttattaccggacagatatcaccgtatgatgcgatcctggccatcaaccccggagtcatgctctttttgtttggcatgttcatcgttggagaaggggtaaaaaacagcggacttttggaagactgtatcacgtggatctgccggcatgcatcatcaggtaccatgcttctggttctcatcatcgggaccatgggactattatcagcagttttgatgaatgacaccatcgctattatcggagcacccctcatcctgattctggccgggcgacttggggtctcaaaacccggagcaatgattgccctctgcttttcggttacaaccggaagtgtattcagccctatcggaaatccccagaattatctcatcgcctcatatgttccagatctgtccccgtatctcctctttttttcaggcctttttattccgactctcctctccctcggtgtgatcttcctcttcctgcgtccgcttttcagggaagtcagtaaccctgctgaaggatgcagattcggggagatatctccggataccaaaccatggccggtgtatctctcctttctttgtatattcaccggtatcggactgcagattatcagcgggctttttcagatggggtgggcagttcctatcgagtggattgcaatcaccgccgccattccggttctggttttttcaaaagagcggataagacttctgagaaatatcgactggcacaccctcatcttctttgcagcgatgtttgtcctgatgcagagtgtgtataataccgggttcttccaagggctgataccggagacaggagggacggacattctgcttgtgttggttgcagggattctgttctcacaggttatttcaaatgtcccttttgtagctctcttccagccgctcctgttatcatcgggagtttccccatcaatcgttctggctcttgcgtcaggaagcaccatcgcaggaaaccttaccattctcggtgcagccagcaatgtcatcatcgtccagcaggcagagcgacagggagttcatatttccatgagattattctgcagatatggtattccggtgacattctttcagatgtgtatctatgcggtttttctgatggcaataccctacgaaagcatctgactgggcacacgcaggtattgcagggcatatctttaaatatgacaaataaaagacgatgatttattcccaggattgtcccatgtcaggaatactggtcgttgatgacaagcccgcgcaccgggatcagattgcggagatactcaccaatgccggatatctggtaaccggtaaagcctcgtcaggggctgaagcgataaccatgtttcatcagatggaaccagacctggtaacactggatcttatcatgcctgatatgaacggtatggatctcctcaggatcatgaaggggacaagtccaatggtatcatttctcatctgcacgtccatctgccatgagatgattgcagaccttgcaaagcgatccggtgctgatgctctttttcacaaacctatctctgattcatcacttcttgcagcagtttccaaaatcctgggagcaccgcaccaggaaaaggaagcttaatttaaaatttcatgagtgatgatccgggaggggatcccggacctgaaaacaaggtttatggggtgtatccatttccggtccagtgcagtttattgtgcggggagtgctggatggggggttttttggattgcctgaaccggtcatgtctcttctggttttgtattatcctctggtgaggatggcataccggatgggtaggtgtggggctttttgcgttccagctttggtatcacctccgaaccattcgtgcaggacagttcctgcgcatgtatagttatatttacattctgttatatctactttcctcatggacaaggactctcagctttttgtcagcaattatgcgcattttcaacccatattcaaggagaagattcttcaaatacaaatatctcttcgatggtaacatggaaccggcgtgccattttaaaggctaactcaagggaaggatcatattttcccttctctattgcaagaatggtctgtcttgtcacgccaacttcccgtgcaaggtcttcctgagtcatgtcatgcatagctctgaaaaccttgatcttattcttcatcctcccctccggcaccaaatttccgctcgtaccaggagatgaaaaggatgtacacgatgatcatcagaaagacaatgaacatgaggaggaatgaaaaccgggcaatctggtacgagaatggtccaaacgtgtctcccccgagactgattaccacgccaccaagggcatatgaaaaaagcgttattcccataacctgcagggttcgcagggaagctttctcagtgatcaggtgtgagcgttcatcagtaatcacatcatcaaccatctgccttgaaatccaggctgccaaaaccccgattataaccgctcctgtcataaccaggggttcaaggttctctaccgaccagaaaaatatcccgacttcaagaattgcgatgacaccaaggagaaggaaatatgtgtattgcttcataatgctttgtaacggattagtgtatctacgccggagaggataagtatatttgtcacgataactggcaaaatcccaatcgggctgttggatgcagtatgctaggtaaaaatatggtttctgatcctccgatacgggtgctctttgtggatgatgaacccgggatgctccaggcaatccgggattatctctccatagttcattccatcggggttgatatctgtaattccggtgctgaagcccttaccagggaggatctttttggatttgactgcttgattattgattacgaaatgccggacatcgacggaattgttcttttaaaagagattcgtcagatgaatactgatattcccatcatcatcttcaccggaaagggacatgaagatgttgcgatggaggccatcaacgccggggctgatttttacatcaaaaagggtgggaatccagaggaactcttcactgaactcgcgcattttatccgcacaggtgtcagcagacaccgggctgagcagtcacttgtggaaaaagaacgccggtacagggcggttgttgaggatatgaccgaattcgtctgcaggatgaatgcagaaggagtcatcctttttgtcaactcggcctttccaaaaagtctccaaataccatttgatactctgaacggagtgacattttactcactctacccggaccataagcgggagatagaagaggtcatctccctctgtgacccggacaatccttcagcccaactggaactgccatttcagggaagtcatggaaagaccatctggcacagctgggtaatcagagtcatattcgatgatcggttcgatatccaggagatacaggcagttggcagagacatatcaagacagagggagcttgacaggcagggaaccatactcagagaacttgggatctcacttgccagtagttcaacccttgaatctgctctcagtttctctctgtctgcagcgatagagataggcggtcttgagaccggtgcagtctatctgtatgaccatacctctggcaaactctccccgttccttgaccaggggccataccgggcagcattacacagactctacgaggaattttccaggattggagatgaaatgatcctcaataccggagatccgctctatatgagcatgactgacctgcaccggtatgaaagcaggtttactgcacttgcattcatcccaattatcagatatgaagaggtaaccggctggttcatcctggcctcagacaacctgatcgaagtcccatatgagataagaagtcctcttgagggagttgcgtcacagataggaaatgttatctcacgaattgaggctgaagaagcacttcgggatgctcttattgaaagtgaggagcgatatatgcagctctcagagacatctcctgatgccattgcaattttatcaggtaattctgtagtctatctgaatcctgctgcgaatgcactctttgaagtggacagccctgatgtctttatcaaacaaccactccatgattttcttgatactgacctgcagaactggtttcatgagatcctgaagaccaaggccagagagaagagtccaagagcaggcgaaggatttctcaaaacgaaaaatggccgacagatatatggtgagctcatcagcgttcctatctcccatgcaggagaagatgcaatccttctgcttatccgtgataaaacaagtcagcggatgcaggagcaggcattgattgagagcgaacgccggtttcgtgagatggctgatctcctgcccgaaccactttttgaagctgatacaaacggaaagctaaccttttgtaaccgtggcgttttcgctcttcttagtgcatcacatgttccgggtaccgatatcaccatggcatcagaactggtttccgcgcaggagcaactcaggttttccaccattctgaaaaaggtcgcaaatgatctgatgccggtttccggggactttattgctgcaggagacccttcggatccgcgaattattcatctttcccttgcccccatcctccgtgacggggttttctccggcacccggggtatcctcattgatattaccgagaacaagcggtatcaggagaaactccaccatatgatcgaggagaaggatgtgctctttcgtgaactgcaccacagggtaaagaacaacatgcagatcatatcaagcatgctccagctgcaggaagagtacatcaccgatgaagtcatcctctcagccctccatgattgtgaacagcggatcgactcaatggcccttgtccatgagacattataccggaccgagtcacttgcaggcattcccttcgggcagtatcttgaggatcttgcacaggcagtgaccgagggatttgcaaccgtaagggatatcaggactgatatcgatgtcggaagtatcatgctcaatctggataccgctgtcaccatcggacttatcgtaaatgaactgatggtaaattccatgaaatatgcctttgtggaccggccttcagggcttatcaccatcaggctgacgtgtgaggatgagggatgcaagatgcggtattcggatgacggagttggtctcccaccaggatttgagattgaaaagatctccagtcttgggatgcgacttgtgcgtatccttgcaaggcagatacgcggatcattatgtattgagagtgaacctggtgcaggaatgatctgcaccgttaccttcccgaaacaggcaggaaatatatgacccaggtgcttatcgttgaagatgaggcaattgtggctgaatctatcgcatccaaacttcgccggtacggatatgaagtggttgatactcttccgaccggagaagaggcagtagataaagctggaaaaacgaggcctgatgtgatcctcatggatattcatctggcaggaaagatggacgggatacaggccgcagatcggatctcaagccagtatcatatcccggtgattttcctaactgcctatgctgacgaacagaccatagcccgtgcaaaagaagcaggtccctttggataccttgtaaaaccattcagagaacgggacctgtacgtaacaattgagatggcacgggagcgatccaggcttgaagcagaacttgaggcggcaaaccgggaacttgattcgttcagttactcagtatcgcatgatctgcgggcaccactcattgctattgatggattctcccgtatccttgaagagacctatgccgggtaccttccccctgacggtgttgaatgtctgtccagaatcaggcaggcagcaaaccagatggaccagcttatcgaggactttctgcggctctcacgagtaacccgggcaccactccagatggagaaacttgacatctcccgtatagcacgtgatatcctgggtcagctggcaacgcatgatcctgaccggagggttcactggagggttgaggaaggactggcagcatatggagatcctggcttgtgtgagattgcccttaaaaatcttatcggaaatgcatggaaatatacgatgcatactaataatgcacagatccaggtaggtagcctgatgcagggtcagacacgggtgttctttatcaaagacaacggcgcaggttttccatccgagaaagcaaacctcctcttcatccctctgcaacggcttcactcccaccaggagttccctggaaatggcatcggccttgcaacagtacaacggatagtgcaccggcatggtggacggatatgggcagaaggggctaccggtgaaggagcaaccttcttttttacccttccggaagaggcgggataaactggaggatatatgccaacggtacttattattgacgacgaggatcttgatcggaaagtccttcactccattctgctttctgcagggtatgaagtagtcgggacagcacgaagcggagaagaggggataaaactcagtcgaacactcaagcctgatcttatcaccatagatcttatgatgccgaagatgaacgggatggaggtcctcataaaactgatgaaggagaatgccaagacaaacgctttgatctgcacatcagcccattctgacccggttgttgatctggccatgcgatatggggcaaagggatatatcatcaaaccattccaggccagatccctcctcgcaaccgtaaaggaagtagtcggagcacctgaccctgcacggatgaatgtgtggaatttttaaagattcaaaagcgagggatagatacagatgggaatcctgattgtagacgatacagactttgatcgcaatctcctcagatccattctgctctctgcggggtatgagatatcaggccttgctacctgtggtgaagagggaatcaggcaatatcatgcattaaagccaaatctggtcatgctcgatctcattatgccagacatcaacggaattgaggtcctgcgaaggatcaggatcgatgcccctgatgcaaaggtaatgatgtgtacatcagtcggtgaggagagcatggtagaccttgccaggcggatgggtgcacggggatatgtagtaaagccctatatcgcggataatcttcttggtgcagttcagaaaattctcggtccgccgggaaaatccagaacctgatactttgcattttcttttgctcctttttaccggttatttgacaaatattcaaaggctataaagaaggaacaatgatactatgtactacggttcctttcccatgctttcctgacaaggtcagaccgactttataggttcccggattctgataccggtgaacaggattctcctcccacgaggtatatccatcaccaaaatcccagaaccagacgtcaggatccccaccggatgtggaatgaaacctgatggtggctggatcattgggatcatcttcccaggtatatgatgcacgatacacatcaacgacccccgtatcccgtgcctggctgcaaagatttgagaccgtataactgacgagatatcgtccggggttttcataccggtgaaagaatggatctgattctgacgttgttgttccatctccgagattccatgtccctgacaggggattgttcgtcaccgacccggttgagcgctggctgaatctgacctcaagtggcgcatatcctgatactggttcgatagtaattatggtatttacttcagggaccgtcccgactgatacttgtttattcatcaaagaccaggcctggttggttgcatcagcagggtatgtgatcgtgaagacatcgtggtgaattccaggcagaaaaacaaccggctgacccctgtctgcagaaccgggatgaaacatatttaattccccgaccggaagggaaaccgggtgatcatgtctggatatatacccgaatctggcagtataagaaccatcggcatttctgcataccactccggattcaggaatcagcatccccggaaccggtgtcccggatggaacaggagtctgggtagcgagaggggtggcaaccggcagagctgacagggaagccatcaggctgtatcggttcaggacagatgttaccatctcctggtccatgatgtagcgcgctccctgtgttcgttcagtactcccgtcccaggagagaaaccggatcatggctgcctctgccccgggaggaggatctccttgaaaggtatacacatcaggatccggtcttgtttcttgtggataatcctgaaaagagtaggttcggttctggtgatcgacccataaaattcgtacaatccagctatcagcagaactcaggtcctgtccggaactgtcggaaatgtgaggaagaagcgatgtattgctgctctgttccggacctggtccagcggtaaataaaacagatattcctgcagcgataatgagtgatataacaatgatgataagaacgaaatgatagtggttatcagacggatccattgcagttcttacatctttcatgtcataagccaagagggcttcccatcagttcatgttttataaggaatatccgattatgaattccaatactatcatctttcagaatacatcgcgcgaaaaacattcagtaattactatcaggatgatgtcacactccaccgtagttcccgtatcagtcctgatcactattctggtcctgaccggtccggtgcttggcactccgatctccacagcaacgccgccaggtatgaacctgtcaattgatccaggagaggatttcttttcatacgcaaattaccactggattgccgaccatccggtccctgaagatcaaaaattctatactgcttttgaagaagtaaaagagttggttgacagccgggtgagaacgcttgtagaagaagcagcatcagattatgatgcagaaaagggaaccccccggcagttactcggatcattttaccgtgcagccctgaacgatgagtcaaatgcaaggacaggacttaccccggtccaggatgaacttgaggaaattgcacaggcatcggatcggagtgagattcgcattgtcacatcaaatctcaccgcacggggacttgacccattttttatcctgtatattgatgaaaacccggagaagagaaaggagcttatcgcgaccatagagaccggtgatttcaccatccggttccctccattctatgaacttgaatttgatgaggccatcagggttcagaatctgatgaaagagtatgtcactacaaccttcatggaacagggaatggatcgtgaaaaagccctccatgcagccgatgtggtattcaggattgaacgacggatggctcaggccgagatgggtatgaatacttcccatgcaaactcctctgaagaactcaaagccggaacataccaggtagcggatctgcgtaccctctttccaggtatcagctgggatgctcttctggagagatcaggaagacctgatcttcaggagatttacattatgaacccgcattaccttcgggaagtgggcaggatactctcatcagaaccggttgaagatctgaaactcttcctgacctggcgggttctccagtatgcagcaccttatgccacccctgaaatgcaggagcggtattatgaattttatgatgtgaaactctcaaaaggggagataacacctcaaaaggatcggatttttggcatcatgaacctctacctgggaaacccgatcgcccatctgtatgtggatcggtattttagtgcttctgacaaggcaaaggcagaagagatcgtccggaatatcagggaggtaatgagggaacgggtgcagaacctctcctggatgagtcaggagacgaaggatattgcccttttaaagatggattacctgaaagagcaggcaggatatccggaggagtgggggcagtaccggaacctgaccatcgaagacacgtcataccttgaaaacatgctggccctgactgaatacttcaccaacgggagcctgcagctctctggtgagccctccgacccggatgtctggtatgtatccccgcatggtgttgaggcacactatgatcttgtccataaccggatcattgccccggctggatttttaaacccgcccttctttgatccgaagatcgatgatgcctggaattacggttcattcggctgggtgtacggccatgaactcattcacatgatcgacattggtggccagcagtatcaccctgatggtaaaaaggagaattggtggacagacagcgatgctaacgaatatttccatgcggcatggcctctgatagtgcaggttaattcaacgcaggttcaagataacctgaccctgaacgggacacagatgctgatagagagttcagcagatcttggaggccttacgcttgcatataatgcatttctcaaatcccgatcagatcccgatacacttgatataccgggaattgacggcctgactgataggcagcggttctttgttgcatttgcccaggccatgcgggggaatattaccgatgagaatctgcgtaatgttaccgccacagaggatcatccctggaataaattcagagtaaatacaatcccttaccacctggatgcattctatgaggcatttcctgatatcaatcctggtgattcactctacctgaacgagactgagcgggcacgactctggtgatatgatgcgaaatttttcaatcctctatgaaataactgcgatgatgatggtcattgccatcctcatcccttcgatacccgcaaacccggtacgaggagctgatgatcaattcctgaatattcaggcaaaaacagatcggagttattatagtccgggtgatattatcaggataaaagggacggtttcaggagaggaaaatatcccggtgcagtcacgactattgtttcagtttcagggcatgaatacaacagcaaacacaacatctaatggatcattctctgcacgagttcctatctcgcttattgaacctgagagcatgtatcgccttattatttctgctcatgcggacgggtatgaagaaaaaaatctttcaatccccattataattatgggggagccctcttctcttgctcccgctcctgttattccggatgaattctcctctatctgattttaaccagggagacatccacatttctagccttgtatgggtactgccgttcaagggttgaacgaagtacaggggtattctgcccatccctaacccatcctccatcatatgaacggcggatgatatccgtaccatactctccggtcttcggattgtaagagaggatgaggagctgtgcggcatctgcaccccggtcgcgggcaacgatatcaccttcccgatatttgggctctgtacccggaggagaggagtctgcccctattcctatctggctgagagcgatccggtttactcgggcaggataggtgtgttcaagatcggccctactcatccattcggcagtggtatcaggacggtatccccattctcccgtgtagtacctgctgattgtatcaattgcatattcatcggttgccggatcatatcccaggacaacacgtacctcctgggtggatcctgatgaccgggagatgagatcaccgggaacatagagagggttttttcctgctgcagaggtcgtggtgcttcgtgcctgatagggagttgcaggtttgaagactgaatcagccggtaccggcagctctgcagttttctgatagagcaactcgtactcctgcatgcttccattcctggcaaggcctggctgaactacaaaatacccgtcatttcgtctgattaattcctcaatccggtactggttatctggcagaagttcagagatgagcaggtaggtcccattctcttttctgagcagaacatccccgggtttaaacagcggatcatgggggatgaataccggttcttcgataaccggttcttcctctatcaccgggagggtcagggtctttgttattacctcacgggaagattcatcctggaacagtgcagtcacccggaatgtgacaatattattatcagagacaggatagaggtcatcaataggtattgccagggttgagggaggatatggattcaatatccgggggacggggccgagtgagtccatgctctgattgtttactgttatctcaaatttctgcaccttttctaaaccagggccaccgggattattgatgatcaccagatcttcggtgatatcaatgatcaccgggatctctccagatgatagtgcttgtggaggaggattgagaacaggagggagaaccagggctagcatgacgataagggcgataatgccgacaatcccgatggcacgatataaaacaggaatttctgaaagctgagggagttgtaatgcggagaggtgatccttcacactttttttcatatggccttgattcttctccctgtttctcatgtatacttcattggaggggtcaagagtaagggcattctcaaagcacacttcggcatcttcatattttttcatcctggtaaagaccacccccagggcattccaggcacgatgatcttcttctgatgcctcaaccacctgcatcaggagatcggatgccttttgtaattctcctctccgatatgcctcaattccatttttatacagtatctgaatatcatcatccatcatggaacacacctgacccccaatcaaaccttacttattatatggttttctcacgaagaaagggtatccccaatcaatactgcttgtttacgctctgtcatgccatatggccggaacgatgacataaaacgtcgacgtgagggaggtattacggactgaacagggaggctggtgaagaacctttatattgactttctccgaatatttcagaatgggggagagaatcgtgctgaggcattactcgttgatacttttcggtgtccttgcaatactcccggtaatggtatgtggggcagcgccaggagatatactgaaaaaccaggtattcggacttccggagggggctgaatgggggtatggcctggatacctcacctgatgggaatacaaccgtatgcggtgtagcatatccggatcaatcaattaatcttgagcacctggggaatggcgatgcctgggtcctcagatttgatacgaacgggtctatcatctgggagaaactcttcgggggaaatgagaccgattatgcgttgtctgtgaggaatcttccggatgggggggcggcagtcatcggtaccaccggttcatacaatggtgatgtaaccggctatcatggaaacggagatctatggttcattaatcttggaccagacggaaatatccgctgggatcgggcccttggtggcagtctgactgatgagggatcggacgttgttttactgccggacagaggatatgttctgtgcgggtataccatgtcttcagacggatataccagacgacaactcggggggggagatctctggcttatcagactggacaggaatggaaccgttttgtgggagcagacctatggcgggagcagacgtgacagcggggccagtattaccctgaccggagacaatagcctcgttgcgtgtggaaataccaactcaaccgacggtatggtatccggaaaccggaccagcagcgatgtatgggtgataaaaaccgatctgaacgggaccgtgatctgggagcgttcctttgggggttcgggactggaatggggccattcggtcatcgaacttacatcaggagacctcatggttgctgcagtcactgcatcgggggatggtgatgtcgggaaaaaccatggagcaggagatgtctggctgatgcggattacccctgatggaacccttgtctggaaacagacctatggcggaagctttagtgacaatgtctggaaacttgagccgtcaccgggaggaggagcataccttgttggagacagctactcagttgatggtcactttaccggtaatcatggtgagtcggatctgctgatagctgaagtggatggagacgggaacctgctctggtacagacagatcggaggctcatcagttgatcggggatcctgggtgaaacataccaacgccgataccctgatgatcaccggtatgactgcatcatcagatggtgatatatcaggggatcattcgagtggtgatctctggatccttgaggtggaagggagtactgcccagccggtttcagagtctgaaccactgccagcaatgacgattccggcagaacctgcgatcggcccactgggtggagacggcccggttccgaccgatcctgatggtgatggcagatatgaggatatgaacggaaatggcaagacggacctgcaggatccaacggtattcttcaagtatttctcctggctgcagagtcagggatatgtatctgcatttgattttaatgagaacggagccctggatctgagcgatgtccaggcactatttacggagattcaatcatgaaaatttccccagtatgtattatcctgattattatgatcgggtttgttatttcaggagttgagggcgcgacagtatccatacagcctgcaacactttcgcctggaaatacaggtacggtagatatcctgcttgactcggcatcaacaggaatatccgggtaccagatgaccgtgcagtctgacaatgctgcagtagctgtggtgaccggagcaacatttccttcctgggctgctctctcagaagcagtacctggtgacgggggatcgtatgctctccgggctattgatctgaacagcggagtagaggcgggtgcaacacaggtcacccttgccaccctctcagtacaggcggccggtagcgggactgcacagattacgattcagaacctccagatcgatgatgatgcaggaaatccccttcaggcagaagcaaagagcgggacggtaacggtatccggaggcgcacctccgacagaaccatcaacccaggagatcccggttactcttcagaccggatggaaccttatcagtatccccatgcagcctgctgccggttttgagtacgcggatattttcaaagatgttcagagtgccggccattcgattctgacatatgatccttcagccgggtggataactatagggaaaggcgaccggctgatccccatgacgggatactggatatacacaaccagtccggtcaccatccctctgaccgctcagggatcaccaaccggaccgaagaacctgaacgcaggttggaatcttgcagggatcagcggcacctcaacgcaatctgctgaaactgccctgtcaggaatctcatcatggtcatatgttgtctcgtacgacgctggcaggcagcagtaccgggatgcaggcataaaagggggacagaaccagattatgctgactccgggggaggggttctggatttatcttgatgcacccggcaccctcagcccaggtacgtaaaacaaaccctatatttttatactcccttttcttaggacatattcagaatggagacttggaacatgatgtacaaaaccggattatgctttctgtttattatccttctcgccgcaggagtatcagcaattcctccgctgccatacgaattctatggtaatgtatcaataaacgaaacacccgcagaagttggaacaataattatcgcgaaagtaaatgggaccgaagttggtaacatcaccactactgctcctggtgcatatgggggagcggggacttttgaccgccgtctggtagtcaatggagctgaagaccagataggtgagtacatcaccttctggattggagagaagcaggctgcccagaaggtcaaactctatgcaggtgagtctcaaaaacttgatctgaccttcacccctggaaaagaggggagcatcgatgcatcagtcaccccgtcccagtctggaaccattgccaatgtcccgaccggtgaagaaacaccggtagcaacagagacacagacgaaggcaccgctctttatcgccccgatagcagcaggacttgcattaatcattcttgcccgcagagactaatgctgcaccccgcttctttttttacgtgaccgacacatacctatctcatatgccagaggtcacggtctattcaactcagaactgtccatactgccggcttgcaaaagcgtttttagacagaaataatattccataccgctcggtagatgtgggaattgaccggaaagcagccaaggagatggttgaactctcaggacaatatggggttccggtcatcgttgcaggtgaggaggtcatcgtcggattcgatacagacaaactcagggccctgtttaccaccggaaaaaagccggatatgtttgatgtgattattgtcggtgcaggccctgcaggcctgactgctgcgttatactgtgtcaggaagaatctgaaaacgcttatgatatcaccggacatcggaggtcaggctcttgagagctggaatattgagaattacatgggataccggatgatcaccggtgatgacctgatggcgaagtttgaagagcagatccgggaactggagatcaggattgaacttgatcaggtcaactctcttctcccgaccagtggcggattctcggtgaaaaccgtatcagaccaggaatataaaggaaaaacaataatcctttcccagggaaaaaagccaagaaaactcggtgtggcaagagaagaggagttcatcggaaggggtctttcagtctgtgcaacatgtgacgggccgatctttaaagagaaggtggttggagttgtcggtggggggaactcagcgcttacgactgcacttgagatgagtggtattgcaaaagaagtgcatctcattgtccggagcagcattcgggctgatgcagtgtacacctcacaatacgcgcaaaagcagaacatcatcacccataccggatatgaagtgaccgaacttatcggagatgaccggctttcaggcattattattacaaaccgggagaccggtgagaagaagaccttaaagcttgacggattgttcacggagataggatggattccaaatacttcctttgttgagggattgctcaaattaaatgatcagaaagagattgtgatagatattaactgccggaccagtgctcctggtatatttgctgccggggatgtcacctcaattgcaggaaaacagatcatcattgcctgtggtgaaggggcaaaagcagctctttcagcatttgactatctgatgacacagtagtcagactgataggtaaaccattcccatgcagggatcacctgaatttctttttccatatttcctccgtaatctggaattgtcctctgattcatcgtgagaagaattcctgcttctgctccagttttttccagcgcttccgtaaggccgttgatttcccgggaaaaattatctggcgtaacttcatagctgacctggatggcgagcattgaaccgggtcttcgggcgataaaatcgcattcacccttatcccgaaaataccagacctcatatcccctccggatgagctcgatatacacctggttttcaaatgactttccaatatcctgtgaaaatttcagggatatggcatttctcatcccggaatctattgcgtagatcttctttccttgggtaaactgccgttttaacgagtaatcgtatttcacacattcaaacaggagatatgcatcttcaaaaaatcgaatgtaatttctgactgatgtatcacttttcagtcctgacacctgaacaagtgaggtatacgcatattcacgggtgaaatttgtcatcaggtaatgagcaagaagtttcaccgcactgacatcgcggattccataccgtgccacaatatcccgatagagaatatcctcatatgtccggattacaaattctggttcctggtagtggataaactcaggaaatcccccgtcactcagaaatgtttcaaattctttcagaaccagggcgaggttttgcgttgttttatcactcggatcaatttttttcccttggaggatctccctgaatgaaaagggaaataattcaatcttcacataccggccggtcaggtgagtgcccaattctgaactgaggagatatgcatttgaaccagtgatgaaaattttataaccctcatcatgaagtctcctgacaaaacgttcccatcccgcaatattctggatttcatcaaagaaaaaagcatcagcatttggatttaacttcaagagcaacgtaaggagcgtctgaaagtcatcatgcgtgaatctgataaaccgatcatcatcaaaattcacataactgacgtgattataaaaatctttgaattgtaagagcagggttgattttccacaccggcggataccggagatgattactatcccctggtgggcagaatatttttgaaaatcgatgtctctctgaattccagggtctttattgaaaaacctgtattgttgatcctggatagcctgatcaagagagaagagatctatcatcccattactaatgggaatttaatgctaattattctttttactaaaccgaacgcatacctcattcagggttcttaaaaaataaaacaatccggttggtattcgtccctacggacatgttattcacgccccagatattcgcagtcttggtaaaatcctgctgattgatgataacggcagtacaggtaaaccctgctgtgatcccaagggggatgacatgttcatcaagtctgacagaaccattcctgacttcacccacctcaaatgccacatatccgccaggtctggtaatcctgaataactccctgaatacttcccccataaccgcttcccagtcggcaagttttctggtgatggtgatctgttttcctatctcctctgcatcaagaccattaaaccagcaccgcagccagttgtcggtggcatattgcacgatatcaaggaagggaggagaggttacagtcagagataccgtattatccgggatttcaggagtacgtcgtgcatcaccagtgatgaagagtgaggaatctgccgcacggatgaggttctcccgttgtttttgatcaatcccctggagtaatgaccgtgactttttcagaattatctctctgacatcccgatagggaggtatctggttccggtcacggttgatggtaatctgacgttccggtgataccgcctgattgggtggaagagtgtagactgagaaaaaacctggtgaatgaccggaaagccggtttgttgctaccatcctgatccatgcatcggttcgatccagctcccctcttttctcccggtcaagcaggtagccacggatactgcacaaggtgcgaagggtatcaggatgatagaacatcgagagatcgatctcgctggtttcttccggattgtcagggattgcatacaggcgtgctttgatctcttcatacaccggcagaaaaagccggggttcagtcaggatgcgggagagcggattgatatcattagagatgatctgacggccaagcagtgctgcctccagtggtgttgtgcccctgccggtaaagggatcatagactctctctcccggttcagtcaggagacttatgaaaaaccgggggagctgaggtttgaagcaggcacggtatgagatctcatgaagttttgatgcctgccgctgccgtgccgtccagaactcattggtatacctgcagtactcatcgtcgttgatacacagggtatcacaccgggttgtctgatccagctggagagtggtctgaccatcctgatcaggcagggagaacatccgcagatactcatggacaaagaaaggatcccgcttcatcacagcgtggtgggttttttacccagtgcttccaccagaaccgtcatgagatttttcaccggccggtcactatgctcctggatgtggtattcacagaacggacagatagtcacgacgatatcagccccggttttattgatagcagcgcgtctgagttctccaagtgccgctgcttcatcaggcagtcctgacctgacaccgccaccagaaccacaacactgtgcaggcatctcaacaaaccgctcaacggccttttccagaatttcacggggctgatgtgtaatctgctggccattcatcaggtgacagggatcatgataggttgccgtcaccgggacttttgtcagaggtggaagaccagtttcggttaaaatctctgttacatctttgacttcgaaaggagtctcatagtcgtgcttgagtgtcgcgccacatcctgcgcacatggtcatgaccgtctgaattccccgatcctgaaatgcccggatattcttttctttcaattcattcaggaatgaggtctgtccggttctgataagcggagacccacaacagacctgttcttttggaatgatcaccctgataccggcatttcgcataacttcaagcatatccatggcacgttcaggaagccgtgcattgaacatacaaccggagaaaaatcccacttcacgcttcacttctccgtatggctcaatgacctcatccacgagatcaaggaagatctgttttcccggctcaacgctcctgcctgtcgttctgaccagttcagcaacttccaggtgtctgggcagagtgagtccttcacggtttgcaatctctcggagtttttcaatggcttttcccggtgtctcgatatctttcggacagacccgccagcatcggttgcagctggtacaggtaaagagcccctgagacagggcttcgcggatccggtttcctggctcacggggatcaagggctatccgcatctgagagcgcatagaggtaggccccagaaaatcagtgactttcatcgccgggcagatcgagacacaggagaggcattcgatgcagtcacgaagtggttttatacgctctatctcttcctgttttggaagaatgccacactcacaggtatggattcggggaatggaggatatacctgataccagatccaccatcaggtctttcataaccggaagatcaagcggttcgatgaccataccatcccgtgcctcttcagtgcaggcaaggaccggttctccattcaccctgaccgcacaactcccacactgacctgcgcgacaactggatcggtatgcaagggtgggatcccggctgtgaatcgcatccagaacattgagaacccgcgcgccgtcttcaacctccacggtccagggttcaaggcggggttctgcatcggtgtccgggttaaaccgcgcgacttgtactgaaacgtgcatcaggatctcctccgctctattgtcgccccggtcctggtcaggatcgtatgcccgaacggggacgtctgattatcccagtcctgtgtgacatcagtcctgacatgtgctccccgtgactcctcccgaagaagtgccgcggtcacgataagccgcgcagtatcaatcatgttccgggtcgtacaacaatctatgaatcccgatggatcaactgctttgagcctttttcttgacagtacatcgagtgcggcccttgtttcctcaagtgcagccttgtttctgaaaattcctgctcccttccacatgatccgctgcacttcacccttcatctggtcaggcaggatatcgccgttgagatatccctcgagcatcaggactgcagaggaaatctgatcatccgggacctctccttcccgacgggcatttctccctgctgacgcccctgcccgcgccccaaagacctgtgtttctgcaagggcatttccacccagacgattcgcaccatgcacccctccggcaacctcaccacaggcatacaaaccaggaagcgtggtctgacaggagggatcaatacgaagaccacccatgatatgatgcgcagtaggagcgacctccattggttcggtccggatgtcaaccccgtacttcaggaactgttccagcataaccgggagtcgttcctcaatggtccgggcggggagatgggtgacgtcaagccacacaccaccatgaggagtccctctcccctgcatgatctcggttgcacaagcgcgtgctacgacatcccgtgttgagagttccatccgatccggatcataccgggacatgaaccgctcaccaagggaattcttgagaactcccccttctccccgtactgcttcagtgaccagcctcccccgtgcatcccagggatataccgcaccggtcggatggaactgcacctgctccatatcgatcaattctgccccggcgcgccaccccatcgcatatccgtcaccagtcccactcgtggagtttgtggagatatcatagacccgtgtcccaccgccggttgcaaggaccgtggcatcagcaaggaacgtatagagcctgcctttccggtcaagacccagggcgccgatcacccgtccttcagagatgagcagatcaaaggcggcaacctcatgacatacacggaccggtgtgtgtgccaaccgttccatcaaagttatcatcatctcatgtccggtccggtctccggcataacaggtccgtggaaaacactggcctccgaaaggtcgctgacagatcgtgcatgagtcggtgacatcaaacaccgcgccccaggagatgagatcctgcatccggtcaggggcctctttagtcaggacatgcaccagatcctgatcattgagatatgccccacccttcatggtgtcagcaaagtgatcggcgatagaatctgcctcattcatcaccgcattatacccgccttcagccatgattgtgcatccgcctttcccggcaatggtccgggaaatgagtacacaggttccgtgcgcagaggcctcgatggcagcacggactcctgcacctccgctcccgattaccagaacatgggatcggatgatctcctgaatctgcattatatacacgtcacagtcagaacgactttgatgttttggtaggacagtctctcctccagccacgcctgtagcatcccttttgagaaaaaaagatccatagtaacggagagttgcacctgcatgaagctcatcatgaagtttgggggcacttctgtccagaacgcggagtcagtcagaagggctgtagatattgtatatgatcgctattccagacatgatcgtctggcaattgtaatctctgcacggcggggggttactgatcggctgatcacctgcgcagaagcaatggtcacttcccgggatgcggctgaagtaacagatctcgtcgaatatctgactgaagggcacctctcaaccctgaaagaggtagccccggacttctcccctgaagtcagcgggatcataacgaggcgcattgagaaccttcgtgattttctctatgcggtctaccatctcagggaattgacggtcagatcccgtgattatatcatctcttttggtgagcgactgaacgcaccgattatcagtgccgcactccgccagcgggggatcccgtccatggttcttgacggatgcgaggcaggtatccttacgacagaaaaccatggtgatgccatagctctcccggcaggtgaggcgcgtatcaaaagccggctggaaccggtcatagaccattctgttccggtgatcaccgggttcatgggctgtacagagaaaggagtcgttaccacgctgggcagatccgggtcagactattcggcaaccatcatcggcgctgctcttgatgctgatgagatatggatctggaccgacgttgacgggatcatgaccaccgatccccgcctggtccctgaggcacgggtcatcccccggatttcctacatcgaggtcatggaactctcgtactttggtgccaaggtcatgcactcccgatccattgagccggccatgcagaaggggatcccggtgtgggtgaagaacactttcaatcccagttatccaggaaccgtcattgagggcggtgagcagaaagactccagggtagtgaaggccatcacctacatagacaaggtcgctgccattaccatcgccggagcacagatggttggaagaccaggagttgcacggcatatcttcacgcttcttgctgaacatcagatcaatgtcatgatgatttcacagggatcatctgaagcaaatatcaccctgataatcgaagcaaaccaggtccgaaccgcgatggaggctttattacccctcaaggagcggtgtgtgttcagggatatcacagcaaacgaggatgtttgtgcagtggcagtcgtgggatcaggcatggccgggatggcaggtacggcaggaaggactttctcagcccttgggaaggcagggattaatgtgatgatgatctcacaggggtcatctgaagtgaacatttcatttgtcgtccgccagcaggacggaccacgtgcagtcaaggtccttcatgacgaatttaatctcatgaatgaggaggcatgaagatggagcaggatgcgtaccgggaagcgggtgtggatattgatcttgaagcagcagccgtgaaaagcctcatctccgaactgacctaccggagaacagaccagttcggtatggcatcggagattggacattttgccggattcatctcatttggcaagtatgtcctggcaatggcggtagacggtgtagggacaaagatgctggttgccgatgccttacaggactggtccaccgttggtatcgactgcatcgcgatgaatgtcaatgacctgtacgtcatgaaccttgaaccggtggcctttgttgattatatcgcaacctcagaactctcacaggaacagatgcgtcagattggaaagggcctcaatgaaggagccaggcaagctaacctctccatcctcggtggtgagacggcaacactcaagggtcttgtgaccgggcttgaccttgccggggcatgtctgggcattcaggagaaagagaaagtcatctccggatctgccataactccaggtgactgcatggtgggaatcccttcatcaggaattcacagcaatggcctgactcttgcccgccggatggtcgagcagcacggatcctattctgatcgcctgccatccggggctacactgggtgatgagctcctgcgaccaacccggatctatgcagatgccatccaagtctgcgcggagacagcggttcatgggatgtgtcatatcaccggtggagggctcttaaacctgaaccggcttggggaatttggttacgtgtttgatgcgccacttccaccccaggagatatttgagtggattgcaaaggctggtcagatatcagaacctgaaatgtaccggaccttcaatatggggatggggtacgtgttcatccttccaaaagagggagtaaaaaccgttcagaaatatttccctgatgcgcagatagtagggcatattaccggcacaccgggcattcgtctgaatggaaagaagttattctgattcaggacaatatatctctttttttgcattgtccgaatagatgagtgaatttccgtgaggatcttcaataataagcgtgatgctctcttttccatcccggatgtttataattctctccttcagggcacgtgctcttctccgttgttcatcttcgccatcgatcagaatcccatcaagaaccttgtcaactctgagcagaaccccttccacatttgacacgaacccttcacaggccgggccgggattgatctccaccccaagttcagggatggtaatctttgcagcactactcctgacaaccctgaccgagaggtcatcctcacagcacgcacaatagatgtaccggaccggctcattcgtgctgatattctgcacgtctgaaaaccgatacccgcactcaggacatgagcaggtaataatcagtatatcggaaaaatagggaatattctccgttttatatgtccagtcaacctcttccccgcaggccggacagatccctctgacatcctgttccaagttcaggcaccgccaccgatgcggtcacgggagatcttgacgttttttggggtgatgatcacgtattgctgatcaccaaggccgacaatatctccgtcaacatcacgggccacctggtagaagtctttcatgacccgttcataattgatcttgtccattttcaggcgggtaatgtcaacaataacaatattcccgtcatatacctgatctttgacgatctgactttcccgcagaccagtaaccgtggcgaccttgacaagaagggctgggttttcacttagttcgtactctttcagagtgagatctttatattcgtccggggaagaggtatccttgcttccgaagagaaggtcgcgaagtcccatataagaaccttttctgtcagttgtaataaagatactggtttttcaggcctgacaggcgtcctttcccttttcagaactcaagattccagatatcatcaccgacgtgatgccaggtccgggcaacctttcctttctcctgcgcgaggatgtcggcggcatcatacaatgctatcccaagggccagtggttttccatgacgctcatctactatctgaacgggtttcccggcagtaacatcaggcgttacatcaactacaccaggtcgcatgatgtcagcaccattcaccacataggacaccgcccccatgtcaaccacgatacgtttctgggggaagggacggcttaccgcaccccgcagactgggaaataaaatcccatccttttcaagaaggacaggctccttatcgataagatagagatggacatcctggttcgtctcgattatctcgatatttttcccctcgaactgatctgctccatccccgatctcttctctgagccgttccagtatgccgctcacctgggattttcgtattgaatgtcttctttttgaggtcagtttacccatatgctctatagtacggctacctgaactcccataaacaatacgcacccggctgactgatgggatgacaggtatgtttatgaatcatcccggcgcaatttattcactcatttcgagtagtgcagggtattgatatgactaaaagacctatggatattttagatcaggtcctgaatcgccaaccagtactgatatcccttaaagggggcagagaaatcaaaggagttctccagggatacgacgtccacatgaaccttgtgctcgataaagccgaggagatcgtgcaaggacaggcacagagtatcggtaccctgattattcgcggcgataatgtaatctacatctccccgaatccccaataaggaggcagaataaatgtcaaaaggaacaccatcacgaggtaaacgacagactcagactcacctgacatgcagaagatgcggtcggatgtcctatcacaagcgtcataaaatctgctcatcatgtggatttggtcgctctacccgcatgcgttcttacggctggatcaccaagcggccgaaagttgcaacccattaatcatgtgcgggatcgttggcatcactagttctgccgacgtctctttttctctttattatgcgttatatgctctccagcaccgtggtcaggagagtgcgggcattgccacatttaacggttcaggcctgtgtaaacacaaaggaaacggtttagtctctgaagtattcagtgagcagatgctcagatcgctggtcgggaccgttggaatcgggcatgtcagatatccgaccaccggcgagaaccggcctgagaacattcagccatttttattcacatttcgcgggcatgtgatcgcactggcgcataatgggaacctcgtgaattatcgggagctcagagctcagtttgaggaccgggggcagatcttctggtccacatcagatacggagatcatctccaagataattaccgagtcaatcagaaaaggaggcaccatagaggatgcggtgaagaaatgcatggcctgtctgaaaggatcctactcagtggtgatgctctacgacggggacctctatgcatttcgtgacccgcatggtatccggccactctgttttggcaggacagaatcagggtacatggttgcatcagagagtgtagcgattgatgccctgaatggaaaatatgaacgggatgtgttcccgggtgagatgatccatatctccggggatgagatcaggtttaaacagatagctgtagcctcgcggaaggggcactgtgtctttgagtttatctattttgcacgggctgattcccgtattgacggatctcttgtgtatgatgtgcgcaggaagatcggggcgatgatatatgaggaaaacccggttcaggcagatgctgtctgcacggtccctgattcggggactgcatatgcggtcggtttttctgagcggtcctctattcccttcatggaatgcctgattaaaaaccggtacatggggcggacttttatcatgccgacccaggagaaacgtgagcgggcagtcaggataaaactcaatccgataccggatcatctccgtgatcggtcaatcatcctggtcgatgattccattgtcagaggaacgacatcacgccggattattgagacgatgcgggatgccggggcacgggagatacatatgagaataggctcgcctatcatcaaggctccgtgttacctgggggtcgacatgcccacgagggcagaacttatcggcagtgacaaggacgtagatgaagtcaggaaaagtatcaccgccaccagtcttcattatatatctattgaatccctggtacgtgccataggtctcccccgtcatgacctgtgtcttggatgtctgaccggatgttacccggttgagatcagggatgagcagtctgatgatcggtgcattaccatggtagaccgggatgtgcagacatccctgttcgagagaaaattttttatgccagagagaagtcaggactggatagcgcaggcgaaattcgatttgaaagcagcggttgataattgtaaagctggaaattatgaatgggcatgttttatatcagagcaggcagcagagaaatccataaaagccttgtaccagtattatggaggtgacgccaggggtcattctgtcgagaaactattcatcgggttgacagactatgttgagatctctcgagagttactctctgatgcaaaacgacttgacagactttatattatcagccgatacccggacgggctgacatatggtacacctcatgaacactttaccaaggaagatgcacatgtggcaatcagcagtgcaggaaatatccttagattctgtcaggatattctggcttgattaccctctcataacagaaagattaaaggagattttagagaaatttaaggattatcctgagatccttgaagtctgggtgtttggctcttttgcacaattaaaagcagtccccgggagtgatatcgatctgctccttgttatgaaagaaagtgaaaaaagactcatcgataggatagaaaggtaccaggatatgttctcggacatgggaatgagtgtcgatgtttttccctacacgattcaggaatctgatcttccttttgtacagaatgcaaaacgaaccgggatatgcatttataacgtatcagatgagcaggttggtacgcagggacttttatatcttgaagacgctgcgaaagatatcttgaagacgctgcgaaaggaaaaagaaaacgtatacgatgacagtaactcattaatttcgtgaatggcatactgagtagaatcaggctctctatctgcgaactatcaagtgatctcactgtgatttcttagagagtactgtgacatataccatccttgttagtgacgaactcgcggaagaaggcatagaaattcttcgcgaacatgccatggtggatgtaaacaccgggctttctgaagatgaactggtagcaaccattgagaattatgacgcgctgcttgtcaggtcaggcacccaggtgaccgagcgggtcattgaggcaggcaagagactccggtttatcgggcgtgcaggggccggggttgacaatattgatatgaatgctgccacccgtcgtggcgtgatagttgccaatgctcctgaaggaaataccctggcagcaaccgagcataccatggccatgatgcagtcactctgccggaatatcccccaggcgaatgcatccatgcaggcaggggaatggaagcgatccaaattcatgggtgttgaactgaatgagaagatcctcgggattgtcgggcttgggcgtatcggacgagaggttgcaaaacgcgcatcatcatttaacatgcatatcattggatatgacccatttatctctccggataaagcagcggagatgggcatcgaatcgatgtctcttgaggctctctttaccaaagccgacatcatcacggttcataccccactcatcaaagagacccggcatatcatcaatgaaaagtccatcgccacgatgaaagacggggtccggattattaactgtgcccgtggaggaatcattgatgaagcggcattggcggcggctgtgaaatccggaaaggtagccggggctgctatcgatgtatttgaagaagagccgccaaaagactctccgctcatcggcattccaaatatcatagtgaccccccatcttggggcaagtacggtggaagcccagaagaatgtggcaatctccatagcaaagcagtgtcttgaggttcttggtggcggtgatgcgaaatatgtcgtgaatgcgccgatcatcccatccgaacaacatgagatcattgagccctatgcaaccctgggagagcggataggccggctcatgatccagatcgttgacgggcgtgtccagaaactggagatgatctatggcggggatcttgctgcccttgggcagtccacgaaacttatcacccatatggcgatcaagggactgctcgatcctatcctccggttcccggtcaatatggtaaatgccgcgtacattgccaaggacagaggtattgccgtttctgagacaacaaccggcgagtctgcagggtataaaaatctcctcaccatgaaggtaaccactgatagttctgaactggtgatcgccggatcagttctgtataagggtggcgcgaggatagtgtcaattgcagggtacaccatggacatggtccccgaaggagcggttatcatctcacggcatcttgaccgtccgggagttattggcagggcatccaccatccttggtgaacatcagatcaatattgccggcatgcaggtcggcagattccagccaggtgaggaagcaatcatggtcctgaatgttgatggggatgttccggaagaggtaatggaagcgatccgtggtatgccgggtatctactcagcaaaatttgccaggatctaatctttttttcaagaacagatcaaaatctataaatggactggaaggctacattgtaaggcacaaccgggggctcgtggtctagctggttatgacgtcgccttgacatggcggagatcctgagttcgaatctcagcgagcccatcttttttcgatacttttatttagttgcaggaagagggataactatgtctatcaatttgagaattctgaaaagtgttatcatattaattattttaggattgatcgtgtcatttgtgcaaggtgcactggtttcaggaagggagccgactggaggtctgaataaactgactattgataattctcaaggtgaactagatgcattagtagttctaacgcaaccaaactggccaaatccaatctgctccatttatcttccaaaaggggaatcacatacatttgagaagatgaagccaggattgtatgatatttattatatcctaggaaaaggttggatatctacaaaaaaagcgtttgctcaggaaattgaagtcggaaagattgatcagccaattgaattagtatccgaaggacataacaccgtagaatcttataaaattgtctgggattatgttccatacaacgataatgagtatattaccgactttaatacagtaacagttaccctgtatcctgttccaaaaggaaatattgaattagttctgatagagagagaagattttcctaaatactaatttttttaatttttaacttatgactatatccttttgagatatcatgtcatttttagtgtattttgcaaagaatggtaaagtcagccaatagtaagaaatagtatcttggccgtatctatcaccgtcattaaattctcattacaccggagactatccaagaatatgattttttatttatttaagtaagtatataaggtctaattcgaatttagccacttatttatctccaatttagagatatttatgcactcgatttctcggacagactcctttaataattgaccggtaataatctgcatatcgtatcagaggtttacttttttctttggatagaatattgcacgaagattcatacattccaatcatttccaatcattattttccattatttgattctcacataaagatagctcatttcatgctccttcacgcagatgtactatcgtgaatcagatatacaccatcattttagcaggaggggtcgggaccaggctctggcctctttcgagaacctactatccaaagcagtttcttcaggtgaatggtcactcactctttcaaaagacgtacctgagagcagttgaaaacagcaatccttcagatatttatgtagtaacgaatgaactacatcatttcctggtaaaaaatcagataaatgaactcagatatccaattgcagatgagcagatcctgctcgaaccttcaggaaaaaacaccctcccggcaattgcgtggggagttacagaaatcgcgaagaaaaacccggattcggttatcatggtttttcccagcgatcacctccttggagcatcagccggtgaggagttgcgttcagcaatccctttatgtgaacactacctggttacatttggaattattcctgacagtccgcataccggatatggatacattgcgcctggcaatccattggagaaaggattccaggtacacgagtttaaagagaaaccagatgaggatactgcacggcagtatgtgaaggatggatatttctggaacagcgggatgtttctcttttctgttcaggtttttatgaatgaactgatacgatatcagccgattattgcagacatttttgaaaaggggggttcctgggatgaacttccttcagtttcaatagattacggcattctcgaacattcaaataacgtagctgttgttcctctttcttccagttggtccgatcttggtaattttaatgcatggtatgagatatcggggaaggatgcttgtgacaattcagggaattgtatggccatagagtcatatggaaattttgtgacgaccaaggaccggtttgcagcccttatcgggataaaagacacgattgttgtcgagacttgtgacgcattacttgtctgccggcgcgacatggcagaaagagtaggagacctggttaaggatctgaaaaagcaggggaacccgattactgaaatacaccgtctggtttaccgaccctgggggtcctatcttgggcttgaaaccgggcccgggtttcagattaagcgactgacggtgaatcctggtatgcgcttatcactgcaacgacatcatcaccggagtgaacactgggttgtggtgcatgggaccgctgatgtggaacttgatggaaagcagctctttgtcagaccgggtgagagtacgtttgtccctgcgggagttatgcaccggctcgggaactcaggaaagattccccttgaggtgattgaagtccagataggtgagtatcttgaagaggatgatatcgagcggaccgaggatgactttaaacgggtataaggatcagaggatctgatcttcagatacctcaattgtttttccggtttcaataatccggtatggcccggtggcccgtacttcgtatgggttgttctgggtgctgtatgggagagtgaatgtcccgttcatacttttttgctgccaggtgaagttccgtccctgattcgtggttatagggagttcaatggttcctgttccgggcagagtgaatcctttcacccgttcaaatattttcacttcttttatctgatgggtttcatcagctgcaacagttgtcggtgattcatagatgagccggtaatgaccaagggccgggacatcggtgatgggtttggtgaactggatggaaccgacgatctggttatcggatgtggggaatttttgtgcgtcttcagaagagatttgaatggcattcgtgattaatttaaaggagcctccgctcattggtgattgctcaatggtcaggagtgatcctccctggcccggagaatatgagccatcggagagatgtaactttacagcggtactttcgaaatatggctgttttaagacgagaactggatcatatctgccaccctgcccggacggttgataataggtctcctggtattgagagatacgatctctgccatatccccacaggggaagggcggcaaatttcgaggtgacggtagcaaagtctgtgatgatatattttgcttttacatcatccgcgtttaattctgcattctcttccgattgagctgccaggaattgtgcgaccggagggacattatcctggaagggtgatgttatggggattctttgactaaggaaggttatccagtgtccataatcccaccaagaaagaacgccatatgatttttccggataggtgaattctgttttttgatagattttatgataatcaacacctgtatcaggggagatctgtgagagcctggtaagagagtcagcccagtcatttgtcattgagatgagaccgatctgcttatctgcaacggtcatgaccgtctggactgaaaatccgacgatgataagcattaaaatccctaccactgctattgcacgatatgggagattctgatctttcatctccaggtttttctttgatcgtttctcaggctgctcactcgctgcaatttttgaatatattgtgctgagtgcgatcgcagaaaatagcacaataactatacttacgtaatattcataccggacatgcatcagagtcgcatacatgagaacgattccccatacaagaattgccattaaggcaggttgatacgaacgaatcagcctgataatacagatgacaatacctactaatgcaagaaatatggcaatattgtaggagtaccacgcccgtaccggttcccacatctgcatctcattaatatatgattcagcatatgaaaagaaaaagaaatagtggatagagttgtttatctgggcagcaatatcaggggtaagcatcgcaatgaatgcatatcccgcggcgaatgaggtcaacacagttccaatataatgaaaccgcggtttctttgcgaacagatgtgcgaagagagtgagaaatcccagttcaagagggattgccagagctgccagaatatgtcctatcgaatacctgctcaaagaaaacccatcatgtgttaatccaagagggagatagaggactgtaaatgtaataaagaagaggcaggtatgtagaaggagaatgaaaagatgattccggtcccggagtactaatgcatggatcaggaagataagggcgcagattgctgcaaaaagcaccatggtctgaatgttcataagacccagaaaatatacaatcccagcaaagatggcaaggaggatactttttttcgtataccagggcttttgaatggtgctcgtggtgagtaggagagcgactatgagggtgatgaaaagggttgagaagagtgtttctgtaatatgatgatcgagatatccataaaaagaacgatataataactctccggagatgaccggaagaagtattgctgctatccacccagttttttcatccccggataattttcccagataccagattatgggaatgagaaggagaaatattaaaggaggaacgtatgatgcgacaatcatattttccggtcttgacagggcaccaacaagaacacagacagatgcacagaggaatgggaagagcggaccccagtcgacatcctttcctgtgggaaacgcagtcatgggatcgaaccaggcatatccggggtaatttgcagatatttgctcaatctgacgcattgagtaccaggtatccatgaaaatgagtttctgaaccggaccattgccaaggaaatccatgggtaaaatccggagccagagtccaaggagggcagaggcaatcacaaggaggagaagaaggtgcgatgaatgtgtattcagccagtcttttgatcttgtcattatgagtactatctgactttttccttaagtattcatttccgaacaagagagcatccccagttcttctatcatgagggttgcatcaataagtgccttaaatcgaagtccagctaaaatggaaataatttgcatacaaaagtagtttcgtcaggatggcaatactatactcatatatggaaaaaacaaataatcattaccggcccaagagctcatgatgtaggttactgccctttttactctaataagcccaggtgaacgcttttacccacttttttacaataaataattcatttaatggacgcaagaagcccttatcaccttttgtgaaacagaagagaaaatatcttcttttttttcgtatatatcatccaatagaccttattttgacgaggttacagagatcagatctgaagagtacaggagaagttgtacctataggaacgttccttcaggatctttaatttaaacaattacgcacggggattccagcgattctcataattgatgagtctcaacatgagatgatctccctttagaaaactatgctagataaacaggatcagatgatccatattcaacaggatacggttgatgaaattaatggatttcgcaaagactcatccaattatcttgaaactgaattttcagatattaaaaagaatttacaggcaattgaaaacgccctttcatgtgaaggaatccgagtctaatcaggctatgattatttttgtcagtttttttcccaagattttcctcagttaccagatcatttatccttttgaatgaaagttattagtaaaactggtcatggcatggtaattgaaccacttgtaacgataataattccggccttaaatgaggagaagacaattggatcctgtcttgaaaaagtcagggcagggtgtataaaacacaatataccatttgaaattattatctctgattcctcaacagacgcaaccccggaaatcgcacgttcctttggagcccggattattcatcctgataaaaaaggatatggcaatgcgtatctagccgcttttcctatggcaaaaggagagatcgttgttatcggagatgctgatgacacgtatgacttttctttgatctctgaattaatcagaccgataaaagaagagagggcagatatggtaatcggatcaagattaaaagggaaaatacttccgggatcgatgccatggctccaccaatatatcggtaaccctctcctgacaaggttattaaatttcacttttcattcaaacttcagtgacacccatagtgggatgcgggcgattcggaaagatgcacttcagaggttaagtctccataccggagggatggaatttgcctcagagatgcttattgaggctgcaaaaaagggactgagggtcgaagagatcccgatcacctattatccacgaaaaggaccttcaaaactgcacagttttgctgacgggtggaggcatatacggtttattatgctgatcaggcctcttcgttttttaatagtcccaggcctcctgtttattcttttgggattttccctgatggtaggagtggggctaataaaatcagttgaactgcaggggcttcattcatttattctaggagatatcctcgtgcttggaggtcttcagtttcttctttccggtgtggttatgaaatcctatagtgttacacaccaactggatgactgtggaccatggtttactcagatactacaatataagacacttgaaaagttgctattcattggtgtgttgtttatgatcctgggttttaccagcggtatatacatattaagtcagtggattacagtttccggaccactgactcaaataacaaacgctgttctttcgctatcaagtgtgataatcggccttcaaataatatttacggcacttcatgtgagtatgatgcttctccagtgtgaacgggatggatgctcagggtttatgggataatgtgagaggctgttgcacagattaattttgaacatacaatacgggaaattaacgatgttaatataaaagttcacatgtttaatttgccatataatgctaatgaaaaacttttatgcaacagcctcttgatatatttttttgatagggcgaacctggaaatcaattactatgatttaagaaatttactgcataagaatggttttcaggaacaacgatctcttaactcccgtcttcttttaagtgagcagaccgaacaataaggaggttattaaagaagcagttgcataaccaaaatgcaatttccgcaagaggacaatttccattcgagtggaacctaaaatcggcgataaaaaatctaatttttcctcattgtaccagcggtttaaagttatgcaacaacttctaaaattaatatttaataattatgacatcatacctgcattttttagaactgtctgaatttcatgtaattgttgttctataaattgatattttgtattgagagaatctttgatatctgatctcatctcctgaatctcctgatttgtaattttttgaagagagatctgataattttggttcgccaacatctgatcctgtttatccagcatctgatcctgtttatccagcatctgatcctgtttatccagcatctgatcctgtttatccagcatctgatcctgtttatccagcatctgatcctgtttatccaacatctgatcctgtttatccaacatctgatcctgtttgaccagcatttgttctccaatttcaacagaacggcgactgttcgaatctatacgtaccagatacgtgagggcagcatccaggcgttctccgagttcttcgtctggtttccctctttgaatctcgaaatactcccatttcccttcataggttcctttgtcaatttttattgattcaacatagataggatcctcatgtatttttatttgagaaataaaccgatccaagtcaacttcattgccttctgcgataatttcaacatcatatcctgggcaattccggacaatccctgtaatattattttttctggcgatctttgtgacccgatcccggtatccgacacgctgaacttcacctattgcagtaattattagacgtttcatgaatatctcatatcagttttttctttatattgttgctgattatgagaagaaatacctatcattcaaaaaattttacaggtttaaaaacagtggaaaattaagcctgaatttattgccatatagatggttttttcagaaataatgaaaaaagtgaaggtaccagaaaaaattgccatcctgcttcagctattctttgctcataatttttcgggttgtcactccaccggtaaccggatgagtgaggtgagagatgaattctgcttttttcattacctctcgagaatatccggggcctgatcttctgattgatcacggttttgcattccgccatgagtgtccgatcaagatctattgctacacgatctatctcatcacctttccgattccaccaggggcttgtcaattcatactgaaagtcagttctccttcctcatagggtatataatacatcagaattacaaatgtattcaagatgaatagagatcaggaggggttttcgagcgatgaaaaggtaatatttaatgttatttattcatatgcatcacagatacaagaaaaatatggggaaaaaattaaacgagtaattctgtttggttcatgggccaggggtgaaggtaattctggttctgatgttgatttattggttattacttcaaaattaccgataaaatccaaaatagacataatagggactgcttgctctttttttaccaaaacaaatgtatacctatcaattaaggttttttctgaagacgaattcgaacaagagagggacttctcgttcattaaaactgtaataatggagggaaagcaaattgcctaatagtgaggaaatatctctttttatcagacgtgctcaggaaacgtataccgtggcatgcgagctacatcaaaaccaccattataatgacgctgtatccagggcatattattcaatgttttatgctgctaaagcggtgcttctaacaaaggatattattacaaggactcacagagggacgatctcacaactgaatagtaattttgtgagagtgggagaatttgaagaaatggtgtggaaatatctgcctttgtctgagactcttcgagagaagccgactattctataccaaaaagaattactcaggaagaatctgatgagattctgacgggtgcccagatcttcatacaacgatgtgaatcgcttatttctcaaaaaatttaaatttcctgacttcttatgaggtttttggtaccaattttctggacatttcggtactcgtcatcttgttgaaaataattcaagttatctatcttcaatttctctttcaaaattgcaattccgtattttttgttatctttttccagaccttttttaggcaaaaattctcaaaggatggcatgatgatactcatcaggcccgatgtataatatacagggcattttcatgagatttgcttctctctttacaggtcatccatagtttttctggtaaaaactcaaatattcaccagatatgacactttttacccaactttgatgttccaggtaccaccggattgtttttcggatcccttcctcaaagggagtttgaggtgcccatccgaattcccgtttgatctttgaggcatcaatggcatatctccgatcatgtccaagccggtcggtaacatacgtgatcaggctttcgttgatctccgggtctccggtcatttcatgcagaagccgcagtattgtttttacaataatgatattttcccgttcattcgagcccccaatattgtatacttctcctggttttcccttatggaaggctagatctattgcccggcagtgatccatgacatagagccagtcgcggatctgccggccatcaccatataccggtatggactggtgttccagggctcgggtgatggttaaagggatgagtttttcggggaactgataaggcccataattattcgagcaccgggtgattaccaaaggtatgccaaaggtatcatggtatgcttttgcaatgagatctgatcctgctttacttgcagagtaggggctgtgtgggtcgagaggggtagtctcggaaaagagacctgtcggaccgagtgagccatagacctcatcggttgagacctggagaaaggttgtgttctttttccacgtcccattctttcgccatgctgcttgtgcggcatcaaggagcgtatgggttcccaggatattggttttgaggaagatcgcaggatcatgaattgacctgtccacatgggattcagccgcaaagttgatgactccctggatatcataccgggaaaatatcgattgaacctgttctggatctgtgatgtctcctttgatgaaaatgaatcgggatttctgatcttccggaagggcggccagattttcagggttcccggcataggtaagggcatcatacccgatgatgatatcttccgggtggatgtcaaggtagtgatatacaaaatttgaaccgatgaatccagctactccggttatgaagatatacatgtttatgttctcccaatttcctttaaaaaccgctccgttgcatcctgccaagagggcaggttatatccgatcacctgtttgagtccaaaattgtcaagagctgaaaattccgggcgggttgccggggtctcgaattcagtactttttcccgggatgagttcacctgaccagccaacctgctgcaaaatatatgcagcaaagtcaaaccgtgaacagtgaccggtatttgtacagtgatagagtccatattgatcagtttggatcaggtcaagggttgcctttgccaggtcgtgagtatatgtgggggatgcaatctgatcatcgacaacggtaatgatgtttgatttgtcactccactccaggactttctttacaaagttgatatttccggagccaaatacccatgatacccggatgagatagtaacgtgttgcatgacgcatgacctcctgttcaccaaggagcttgctctcaccgtaccgacttagtggatccggatggtcggctatggtatatggtcgggatgattttccattaaagatataatcggttgagtaatggactaaagatgcgttcactttatttgctgccagggagaggtttttcggcccgatgccattaaccaaaaaagccttctcatattctgtttcagccagatctacggcgttgtatgcagcacagttgatgatgatgtctggctgaaggttctgtatcgttttagttactacatcatattttgtaatatcaagatcctttgaagtccaggcagtgacatcgtgcccatacttcctacagaggtttgtagtatccttccctaattggccattggcaccggtaataagtattttcatcagtttttcctacacataagtgaaaggtgacctgagttcagataatatcggatgctttgtatctttttcagataaaatcggctcttttatgccaattatatctagaggccatggaatgttcaagtctggatcattccataacaggccggcatctcccgatggataatagagatcggtaaccttgtacataacttcggtatcgtcttcaagagccagaaaaccgtgtgcaaaacctacgggaatatacagcattgcaggatcattctcacgcagggtcactgcaaaaggctttccataagtgggtgatcctatccggatatcaaccgcaacatcatagatagagcctttcagtacccggacaagttttccctgcgcgtgtgggtactggtagtgaagaccacgaaggactcccttttgtgattttgaatgattgtcctggacaaattcatcagtaattcctgcatgagagaaatcttttttgttgtaactttcaacgaaaaaacccctcgagtctttaaagtactgcggcactaccagaaggatacccgcaagtggtgtttttgttatggttaattttcccatgtctatcttccattcccaagagcaagagagataagatactgaccatattcggttttatccaggcattgtgcaagttccaggagttgacgtttgtctatgtatccctgttggaatgctatctcttcgatacaggccacatataatccctgccgtttctggattgtctcaataaactgagatgcttcgagaagtgaatcgtgggttcctgaatccagccatgccatacctctgccaaataactcaacaatgagattacctcgggaaaggtagatgttgtttacatcggttatttcaatctcacctcgtgcggatggtttcagaccttttgcaatggttaccacgtcattatcatagaagtacaatccgggcaccgcataatgagattttggtttttgtggtttttcttcgatagagataacctttccatccggatcaaattcaactaccccaaaagcggtgggatcgcggacataatagccgaagatagtagcaccagtctcacgggagactgctctccggagtatttctgaaaaatgctgcccataaaagatattgtctcctaatattagggcaacccgatcctttccaataaatgattcaccgacgataaaagcatcagcaagaccacgtggttcctcctgtatcgcatacgaaagggagaggccatattgcgctccgtctccaaagagttctttgtataagggaagatcccggggtgtggagatgatgaggatatcacggattccggatagcatcaggacggaaagcgggtagtatatgagtggtttatcatagatggggagcagatgttttgagatgcttttagtcaggggatacaggcgggttcctgcccctccggcgagaattattccttttattgtcacagggcaccaatcaatcagaattaatctaaataaatattgttacttcaaataagtagtgtctattattataatcatcaatctttaatagtgttaatgtcaacaaaatatccggataactgtgaaagttgcaatatttcatgattatttttccacgattggaggaggagagaaggtagtcagtaatattgcagaatgtctcggggcagtagtgtatacaacagatacttcggtattgcctgatgatttgcaccaaaaccaggttttttcattaggaagaatccctcataaaccttttttcagacagatgggttctcttatccgtttttccatgtcagatgtttcaagtaaatatgatatgtttatttttagtgggaactgggcacatcatgcctcactacaccatagcccctcaattttttattgtcatactccagttcgagtgttgtatgatcaatttccggtttttaaaaatcgcattcccaaatctttaagacctgggtttgtggtttggtcatcatttatgcgatcgatggatcagcgttctataaaaagaattaacaaaatagtaacaaattctaaaaacacatataaaagagttttaaaatattataacagggattcgtcaataatataccccccaattaagacaaaggaatattactgtgcaggatatgaagattattggctatccgtcaaccggatatatccagagaaaagaatagaacttcagataaatgcttttgctaaaatgccagaccagaaactcgttatcgttgggggtgttggtactggtgaccatgccgctccttatgccgggaaaatctacaggatggcttctgatatagataatatacaaattcttggtcaaatatcagataaggaactaaaggatttatattcacggtgtcagggactgatttgcactgctgttgatgaagacttcggaattactccacttgaggcgatggcaagtggaaaaccagtcattgctgtcaaagaaggagggtttttggagactgttacttccgaatgtgggaggtttattcaaccgaatgtcaaggaaataattactgcagtgaagacgctttcaaaagaacctgaaaattattgccagatatgcaaggctagggcagatttatttgatatcagattttttaatgagagaattaagactgtcgtcttggagacgtatgaagaatggtcagattcagtataatcattacgaattataatggactgtcatttatcaaggattgtcttgattcactggaaaatcaaatattcaaggattttgaagttattttcgtagataataattctatagacaatagtgtcaattttgtcaaagagcactattcaaacgtaatcttcatcttgaattcaataaaccggggatatggagggggatgtaatgatggtgctaaagcatcaaaaggagattatcttttttttctgaatacagataccacactccttcctgattgtttattaaatttagatgagggaattcatctcttcccggattatggaatgtatgctccaaagatgatctatcctaacgggaaaattaattcaaccgggctttgtatttcattatccggagcagcatgggacaggggactaggggagaaagatatcgggcaatatgataaacctgatgagatatttggaccatgtggcggagcagcagtttttaaacgagaaccttttttggaaattaatggatttgacgagagtttttttctctttatggaagatgtagatatcattattcgaatgcaatcagcgggatggaaatgccggtttcttcctcattcaacagtagtccatcaccatgggggtattacgggcgtgggttcagatttttctgtctattatggaaaccgcaatattatctggaatacctataaaaattatcctaattaccttatactattaggttttttctttatttgtgcacgaaatattggatcaatactgtattatggaaaaaagggaagaggaagagttgtattaagagctaaatgggatgggataaaaggactccctccaataattcggaggaaatattcacaaaagaagggagttaattcttttttttggaagaaatacctgaaaattattgcataccgctcatgaaatgtgtaagtattatgcaatcttcttcaatatattttaaatttttagtatcagagaatagctaaaaaaccccattacaacaaattgtggtttataaatactttatatactagcgatcaccaaaggggggtttttagttatcctcattagatcaattatcagtacccttaatttacctaaaatataattgatatggattgaattttatgtctttgcatatttcaattatcgggggggggtatgtaggccttgttaccggtgcctgttttgctcaactcggtaataaggtaaccattattgaaatagatcagagaaagatcgattcaataaacaaggggattccccccatctatgaagaaggactggaagagatactaaaaaagaattcgggaacccgattatttgctaccaattcttatgcttccgttgcagaaagtgatgtttcaattatctgcgttggaacgccgccgaatcctgacggttcttctaaccttgaatatatcagatctgcagcaacatccattggagaggctctgaaagataataccaggtaccatgtgataacggtaaagagcacggttcctccgggaactactgaaaagattgttcttcctgaagtccggaggaattccgggagagattctgatacccttggtttttgtatgaaccctgagtttttacgtgagggaagagcgattgaggattttttacaccctgaccggatagtcattggctcatctgatgaacaggccgaagaggttctgaagaacctctattcaactctgaatgcccccattatctctacatcgctcactgctgccgagatgataaaatataccgcaaactcatttttagcaacaaaaatttcattctccaatgaaatcgggaatatttgtaaaaaactcggaatagatgtgtatgatgtgatgaagggggccgggcttgatcaccgtatcggatcgcatttcctcaatgcaggtgcagggtttggaggcagctgttttcccaaagacgtatcagcacttatcagtcttgcagagagtgtaggggaaagacctcaattgctgcatgccgttattgaaatcaatgagaaacagccacataaaatgctggaacttgtccgtaaacgaatcggggatctgaaaggtaaacgaattgcagtcctcggacttgcgttcaaggataatactgatgatatccgtgattcgagatcaatcccggttattgaggaacttatcaaagaaggagcggatgtcattgcatatgatcctatggcaatgatcaatatgaagcggctattcccatcaattacctatgcaaagagtattaaagatgtcctaaaagatgcggacggatgtttgataatgactgaatggccggagttttcacatttgtctgaagagttctctctcatgaagcagcctccggtaatccttgaaggacggcggattataaaacgaccggaggttgagggaatttgctggtaatatgagtacacaatctgttcgaaaagtggtaatcccggcagcggggcttggtacccgtttcctgccgatgacgaaagcgcagccaaaggagatgctccccgttgttgataaaccggtcattcagtacgtagtagaagaagcaattttgtcaggaatagatgatatactaataattacgggacgaaataaacgatcgatagaggatcattttgacaggtgtccagaacttgagataaagttcaatgagacatgtatgaatatttttaaagacactctcaatgatctctcgcaatatccggagattcattatgtcagacaacgtgatcagaggggtcttggtgatgcggttcttctcgcagaaaaacattgcaatggggaaccattcgtggttttgctcggagataccataacccttacaccaaaggggcaaccaacctgtacccatcagatgattgcgggatatgaaaaatatgggagatcaattattgctgtcgaaccggttccagaatataaaattaaggattatggtatcattgatggaaccctaattgaagaaaatacataccaaatcacggacatcattgaaaaaccagcagttcaggatgccccaacaaaccttggagctatcgggtgttacctgttcactccggatatctttgataatattcgggagactgagaagggacatggaggagaggttcagctaaccgatgcaatcagaaaacttgatcggccaataggtcttgttactaattgccggcgatatgatattggtgataaactcgggtggatgaaggcatttttagagttatcttacctacgggatgagtttaaagatgaattgaaagatttattcagggaattgacgaaagaggagtaattatatatggcatctcacattattgaagagggtattgaaaaaattattaataataccaatgatctttcatttgataataagcgggttttgataaccgggggatcagggttccttggatcatggctttgtgatgctcttataaggaagggtgcggaggttatctgtctggataattatgcttctggaagaaaggagaataccgatcatctcttaggagatccatcttttaccagagtagaccatgatatttctataccttatattccggaaaaaccagtagatctggttatgcatcttgcctcacgtgcatctcctcttgaatttaccgattatcccatccagattttaaaatcaaatacaatagggacgatgaatgcccttggaattgcaaaaaattcgggtgcacggtttttgttcacctcaaccagtgagatatatggtgaggcacaggtttttcccactcctgaaacataccgtggcaatgttaataccttaggaatccggggttgttatgacgaggcaaaacgggcgggagaggctttttgtatggcgtatcatcgtcagcatcatctggacgtccggatagtcagaatcttcaatacctatggcccacggatgagaagtgacgggctatacggtcgggtgataccccgttttttggatcaggcacagaaaaaccagcctatcaccatcttcggcgatggttctcaaaccaggagtttctgttatgtgaccgaccaagtaaccggccttttgaaactggccggatatgatgggatagacgggtctgttattaatataggaaatccgttggaaatgtcggttctttcacttgctgagaagatcattgagattacagaatcacagtcatcgatcagttatcacccgcttccaccagatgatccgtcacggcggtttccggatatttccaaagctgcagaggtattgaaatggaaaccacagataagcttggattatggccttcgggcgatgattgcagtgtcgtaacttaaaaaattctgatgtgagcaggaatcctgcaatctatctgaaaaggaagagaatcctataccggaagaaagaaggaaaaaatgttcctgcacctgatatctcgatattttttttatgactctatctactattattgagttaccgaaagatctcccaagggtgctggtcattacatcaaatctgggcactctcgcagaactcaggatgagaaatcccctgcgtgctctgcaccgaatgcatatcattgctggatttgaagttgttgatagtgatcttcatccacttcggagtgatgaaaaccggtaccatatcatcatcatccagcgggctgttccggaatatatttatgaatcatttaatgtccggggtataccctatgctctcgacattgatgataatatgctcgcaaccccggcctatcagaaagatgtcgtatataatgccatccataaaggtcttttgggttgccaggtattgataacacccactacccgattggttcatcttctggagagatattccgggtactccttatcagaaaaatcccggctggtcccgaatgcgcttccgtatccgagatcgtttcaccgcaaaccagcccagccggagcagctgctgtggattcagagtgatatttcggcattatcgtccagtattgatgatattgtccgggcaattgatgacttttcactgaaatacgatctgccggtcatccttatcgggcgtaatgttcttgacagaaggacgctttcaaatcaggtcgaaatgggtgaaattgatctcactgcattgctacagtatttatcatatgcaccgccaagtatcggtttagctccgttggagacccaggcagatgaggagaccatggactttattgccgggaaatctgatatgaagatgctcttatttacgggatatggccatccgggaatatatagccgatctcccccatatgaagactctcctttgataaataccagtatgctgaccttaaatacgtattcagcatggcttgatgcgctggaatatcagtaccattccggatggaaggatgtatgtttaaattcggagtatatacgacgggaaagaaatattgaacggatagcctgcaaaaatctcttacctgcccttcaatcatgcattttatccacccctatgagggggatggatatatataatacaatcagaaagaccagaaggaaatatatccctctcattttaggatataacctgttattacggctagggtttcagaaaaatgatatcatgagtctgcataaccggctgaaagaaagagggaaaaaaagccaagataatgactttgagctgaaaaataattaaaatatttctgaatatgatggtgcaaatgaataatcttgccgataatgatgaccatttccgggttcttgccataacatcacatcagggggcaattgctgaactcaggcttttaaatccgctccgtgctctgcaccggatgcacctaatcacagggtatgaagtggttgataccaaccttgacagattgaaaaaagacagccggttgtatcatgtcatactcatccagcgggcagtccctgaatacatttaccaggcacttaatatacgggatattccctacgcactcgacattgatgataatatcctcgccatcccagcataccgggatgatgcccgttataccggtatcctgaccggtctatccggatgcacgactcttattacgcctcatacccgccttgtggcactcctagagaaatactccgggtattcacttatgggtaagtctgttgtcgccccaaatgccctcccatactacggcatcacagaggaaaccatatcgcaaccaaaacagttactctggatccagagtgatatcgctgcattgacagccagcctggatgagattgtccgggcagttggtgacttcgcacgaagatacagcctcccaatcgtgttaatcggtaaaaatgtactggaggatgctattctgcctaaccaggtcataatgggagagattgattttaccgcaaatctgcagctcctggaacagtatcctaccggaataggagttgcacccctagagacctctgcagatgaagagaccggtgacttcatcgcaggaaaatctgacctgaagatgctcctttttaccgggtacggacacccgggtgtatacagcaggtcaccgccttacgaggattccccgttcagggattgcggaatacttgtatcgaatacatacgatgactggtatcatgcgctggagttccaataccataccggatggaagaatgtgtttcctgatgcactccgtatccaagaggagcgggatatccaccgaattgcccgcgataactggatgccggcaatcgaaagatccagacttgataagccaatgtctggccgggagatatatgctacggtgatgagaacaagaagaagatatatgccaatgttgaaaggataccaagtgctgcttaaactgggtgtccagaaaaatgcccttttgaatttgtattatatcttgaataacagattacgctaaaaaatcctcggccttcgtatttttctaaactactgaaagaaattcaggggatttattgtaaattttttccattaaatcaaaaatagactatcaggaaatgaaaagaatacttactatataaatagtaaccccctcctaattttatccggaagaggctctctgtaacttgtcctttttgttaaattcgaaatgaataagcagccccattaaaagtgcacataatgcaatactctttttttaaagagcgggaagtatagcgatgaatattatctaaattcagtgcttcttttccaaatttaaaaacatcttcaataatttatctttgtgcggcaagttcatccgaattttcgagggcatcctttagttcttttttcatatgggagagttcaatgactttttggtaactttttttgttttcaaaccatgttagggggctaattaaatagttctctaattttgagaatgaaaatccttttttcggaagaattaaaggaattacactgtattctatcaatgataatacataatttttgtaagaatagtacccacgatcgagtaacactctatctcctttgtttaaaattctcctccgtttcaattcttgaagaattaacgggaatatttttgaatcagcgactggattctgatgaacaagaaacgctaatggaagaagattattctgatcgatcgcaagtgttaattttaaaccaatataaaatcccttataaggagaatattgccaattatagggtttatttactaactttgatttttgaatgcgttttctgaaccaatttatatcgacagacagcgatgtcccatcaatgattattgtttttcgaaaataatgtcgtttcttggggcaaactgcgtttaaaataccatgagtcattgaaataaattgctctgcagaaaattgactcatgaaacgataaacaccattaggagtaagaatattatctattcgtaaaaattgctgcaattctattcttttttcaatttcatttattgcataggaaatttctactgaaaaaaacattgacagcaatacgatagataaattcgtgtaagcctgatttgctggttttatcccaaattttgcaatttcttggcggcatctacgtgtctctaaaacacctagaattttcttcagcaaaatccatttatgatcagaagtgtctactattatgggagttttcaaaattatcaaatagaattctccctcttttatcattgatctttcggtttttttcttaattcttaaaaggattgaatccgcattgcacttttacaatccaagtttatcagccgcgcgaatagtgtaaataattctaaaatcttctttgtacaccgcggattatcggagggggttaatataaatagaggtaagtgaaaaattgtatgcattaagtataacgttaatgtgttatctttgaacacgaaaacttgattttcaggatatcgggtaaaatgtcaggaaataatcaaaaaaatgttcttgtcacaggtgctgccgggtttattggaacacatgttgtcagggaactacaaaaaacccaagacgaatacaatattgttgcattagatgatctttccggggggtttatagagaatatcccccaaggagtcaccttcatacagggcagtgtatctgatgcaaatctgataacagagctttttacaaaatataaatttgaatatgtgtatcatttgggcgcctatgcagctgaagggctctcccattttatccggaggttcaattataccaataacctcattggaagtataaatcttattaatgaggcggtgaaagttgggacaaaatgttttgtttttaccagttccatcgcggtatacggtgccattgaaccacccatgaccgaagaaaagactccccatccggaagacccgtatggcatctcaaaacttgccgttgaattggacttaatggctgcacattcgatgttcggacttaattatgttattttcaggccccataatgtctatggggagtatcagaatctttcagatccttacaggaatgttatcggcatttttatgaaacagatatttgaaggacagccaatgacaatttttggagatggagagcaacaacgtgcattcagctatgtcggggatatcatcccattgattgttcaatcaccgacaataccaggggcacttaacaatgttttcaatgttggtgcagataaaccatacaccgttaatgagctggctagtaaagtagccatcgcacttggaaagccggatcaccccaccgttcatctcccgccgcgaaatgaagtaggtattgcatacagtgatcattctaaagcaaagtcagtctttggagattcaccacataccagccttgatgatggactagaaaagatggcagcatgggcaaaaaccacaaccatccgaccactaaaaccctttactgcaattgaggtcgggaaaaatatgccaccttcatggataaaatatctagataatcaatgatagaaaaaaacactaatttttctctccaatataatattaatggaaactcgattcaaaggtgaaaagaacaatgaaaatactggcaataacaccaaatacaggagcaatagcagaattaaggatcattaatcctcttcgagcattacatcggaaaaataagatttctggatataaaatagttgattattcgctatcacaactaattggtgataatgattattatgatgcattattaattcagagagcagcccctaattatatttttaattctctaaataagagaaaaattccatatttgttggacattgatgataatttattagctaatgctagttatcgtggcctgaaagccgaattagatctattagagggattaataggttgttctgctttaataacgccgaataaaaggttaatttctttgttagaaaaatattcggaattgtcgctgtataaaaaaacaattgtcgtacccaatgcacttccctatccaattaatatagaaattaaaaataaccaacctgataaaattctatggatacaaagtgatatttcagcattgactgaaagccatgatttaataattaatgcggtgtccgatttctctaaaaaataccacttaccaatagttcttattggtaaatcagtgttgaatggtattacattacccaaccaaataataatgggagaaattgatttttcatcaaatcttcaacttcttgaatttaccactaccagtattggaattgctccattagaaacctcttctgatgaagaaacacttgattttatcgcaggaaaatctgatttaaaaatccttttatttgatggatatggtcacccaggaatatatagtcactcacctccttactcagacacttcgataaataaagactgcaaattaatatcaaatacatatgcctcctggatagaggcattagaatatcagtataattatggatggagagatatcggaaatcgcacgcgagaaatacaaatggaaaggcatattgataaaattgccattgattgctggttccctgcattaaatactaatttattgcaacaaccaatgcaaggtaaagcgatctatgagattatttcatcatctctaatttttgatgctcctttagtttactcgcataattttttagcgagaattggaattaataaacagtggatgcaatttgtgtacaataaattaaaaaattaaaataaatttaggatgataattggtttatttggttcattccaagggattgatcaaatctatttaaacttatatctaaactcaaatcattctattttagatgtaaaaattcaaaaaaatttttcaaatagattacatggaattaaatatagattgcaattctaaaaagatattcgctttttttggtacggacattgagggatattcagataattttttaaataatattgttacagagcattatacaatccttgctttagattcaagagccatagaatctgcatcaaagtcaaaagtcccatataccataattaatgattggatcagccctaacgaactcatggaaatacaagatattgcatgggattgtgaggttaattggtttcggaataaaaaagaggatttcttaataagtggaatatgctggcctgaattagatcataaagctatgagttttttctggcttgattcgatattatcattaaaattatcagagaaattttataataataatgtcagagaattattactaattaatcaaaatgttggtagccccgttatttatcatctgtttggctctatttgtaaaacaatctgggaaagtgagttaaaagaccgggtaaaatttctagaatccaaaaaaaatgatttccagaacaattccgtatttaacatcccacctcatataaaacagcttttattttccccagtatcgttcttaaaaaataaaatagcattttttgcatcagatattgaacttagaagatcccatgatctgcttctggatttaacatcctcttttcaagaacaagtcatcattattccgaatgaaattaacgatttagaccttattagtacaatgagtagatattcaattccagttcttgaaccatacagacctgattcggatgatgggatttcaggaaaactactcaatggttatcattcattaataaaaagatcgacaggaaatgaatgggataaaattcttacaactctcccattccactttgaatattattgcaataaacgatggcctaaattgattaatgagttccattattatattgacatattctcaagatttcccccaaaattagtcattggagcacttcttgatagaattgagtggagtattcctattctatctgctcaagtattaggaattaaatctatttcaattccacatagtgtcagtgtaaattctactaaaaaagtaatagactcagatcttattttcagatatgattatcatctatatttaaataaattctctaaagagattttaactaaaaatcgctcgttatctccagaaaaattcattccctgtcaaaattgtacagatattaattctcattacacaagatgtatttctcctaattatcctaataatgtcttaaaaatattagtccttttttcacctacgtcattatatatataccctacaagtgccagtagacatatattcccacataaaaatccacgaaaacagattgaatctattattgaccttgaagaaatagccaagaaatatattaatgaattatcgataaaatttaagttacaccccggtttttcagaacttgaactgtttcaatcattaaataatgagatattaagtcatattttaccacttgatgcggaattaaagccaatattaaatgaaacagatttggtaattggagtgaattattatggttctgctctaattcaggttttggaacacaaaatcccctttattgagtatataaatgataaattatttatgaacaccatggaatacaatagatatgaatttgaaatattaaaaaaaggcatttatatcatccattctaaagaagaattgataaaaatgatacagaaaattcttaccaatattgattcaataaatgagataaaaaccaaactatcaacattttctgaatattattttgagaataagaattatcagacgattagttcagtaatcaataatttattaaaaaacgatttagagaggctaacggaaaatcgataaaaattcatttattatttaaaaagatatccaggaaaaattatatttacatatagaatttaatattaactaataataccctgattattatgcttccgtcaaaaagatatgaacctgaatttgttaatttagatgataataacaatagtcaatgcatagcaatcaaattaataggtacccaaaaaacaattttagaaataggtacatcaacaggatatgttagcaaaatattaaaagaatatgataatattatttacggagttgaaatagatgtagatgcgggaaatattgcaagaaattactgccaaatgatgattattggcgatgttgaaactcttgaattagagaaatttttaaataagaacttttttgatgttattttatgtggcgatattattgagcatcttaaaaatacctctgtttttttacagaaattgaaacaattcctaaagccagatggatatttagtagtttcaattccaaatttttgccacggtgatgttattttaaatatcttattaggagatttccattatactcctcaagggttgcttgaccagacccatattcatttttttggattaaaaaatatttatgaagatttttccaactgtggatatgagatacataatcttcacagagtaataattgatgtaggctcaacggaattgaaagttaatgaagagaaaattcatccaaaattgctagaatttgttaaatcccttcctgattctaatgtatttcaatatgtcttcacagcccatccaacatccgaaggaattgaaaatcctattaacgatgttgatttagctacaataactgaaaaatttattgaagaatcacatttggaattgcgtttagcgattgcagagctattacaaatagttaatcaaaaagagagagctaatttgcaattagttgcagatcttcaaattcttaaaagtaaactgatgaattgttatttatctgttcgaatttttaggaaatgtatgaaaattcttcaacagtacactcctatggatacaaaaagaggagcattcctcaatttgattactttttggggtaatatctattattatgacggagcaaagatgtttttaaagcgagcaaaaccattaatcatcccattttttctcaaaatgctaaaatgatctctttttacactctttccactccaacatcgtactaaaaaacccctgcctattattccccctccgggaagtatgatcctccagctcaaaagagcagaccgttcttggtgaatcaacattccaactcctcgccctattactagtaaagtttagatatactgaatacttatttggagcaagagatcgtgcaggaatggttatcgtaaaataatgggtacctatttccacgtcatcaagcggattcggggaagagtcaaaagagtcagattgcataacaagagttccatcagatctggatatcgtcatatacccatacaacccaggtatctttttattaaaatgcatttctaattcaagaataactggttcatcacaggaaaacctatatttcactttcccttcctgtgataaaacgcggattttccttaattgtgcttccttttcccgatcttcatcaaatgttgcttctgttatcccatccaccgaaccagactgcagaaggtactcatcgataatattttctgaaggcccgtcagcgatgatcttcccatcacgtatcaaaagacttctcgggcataattgcttgactgcggccatactgtggctgacaaaaagcacagttttaccctctgacgagatatcacccatctttccgatgcactttttttgaaaagcgatatcaccaacagcaagaacctcatcaacaatcagtatttcgggctcaaggtgggcagccacagcaaatgcaagcctgacatacatcccgcttgaatatcgcttgaccggagtatcgataaattcgcgaacttcagcaaaatcaacaatttcatcgaatttttcggttatctctgcccgtgtcatccctagaatcgaaccattgagatagacattttctctcccggtaagttcgggatgaaaaccagtcccaacctcaagcaaacttgcaattcttccgttaatccggacccttccctcagtcggacgagtaatccgggacaagatcttcaggagggtggatttcccggccccgtttttcccgattatcccgaccttttctcccttcttaacttcaaaggagatgttatctagtgcataaaaaagatcacctttcaatcggtttttctcttcagaatagatatcaatcaggcgatttggatcttctctgccccttaagtgggcccaccagctctgcaggtcatttcgcaatgttccatgattaataacaccgagttgatagattttactgacattttcaaccctgattacaacatcattcatttctcaccctcctattataccgtatcaattacggttttttctatatggttgaacaacaccagtccgataatgagagtaattaatgtagtaactgccccaaggctcaaaatccatggttgaaaatagccgttccccagaaggatataccgaaatgtctcaactattgatgtcatcggatttacagcaaaaatccattgccatttttccggaataagagacaacggaaaaaatatcggggttgcatacatccaaagttgaataccaaatcccattgcataggcaagatcacggtattttgtggttaaactagaaacgatgagtccggttccaagaccaaatgctgcaatttgaatcaataatagaggaagtaacaatatgaagatatttgggtgaatagggacaccctgaaatgcaaaatagattataaaacagatatataccccaaattgaattgcaaaagttaacaaatttataattacagttgaaataggaataattaaacgtggaaaatatattttcccaaaaatatgcgcgtgtgccagaaaagtgttggatgtattcaatacacatgcagaaaaatagttccatatgattatcccggacataaagaacaaaatcggggggagtccatctgttggaaccctgataattaatccaaatatgattgtatagacgatagtatttaaaagagggtttaaaatgaaccagaaaggacctagtaccgcctgtttatagtttgcaacaaaatcgcggtgcataaaaaatctcagtaaatcgcggtatctccatatttcacggagatttaaatccaaccacccactttttggagaaatctccatagtccagaattcagctttatcaatttgagatgagatcatattagtcccttaaaaattgaaataatcaaatgtcaacataattttcattttaagacatattatctcatctattaaaaaactggaaccgtttacctttatcattttatacagacaagaattaagaaatgtctttcttcgacaataaaaccatactcataaccggcggaaccggatctttcggcaacgcgttcacctcccgccttctcaataaccataatccgcatagtatccggatctactcgcgtggagaatatctccaatggaagatgcagcaaaagttttccgacagccgcatcaggtttttcattggtgatatccgagataaagcccgtctcactcgcgccttgaatgatgtcgatatcgtggttcacgcagcagcgcttaaacaggttccagcatgtgagtataatccgattgaagccgtgagaaccaacatcgacgggacaacaaaccttatagatacatcaattgacaacaatgtcgaccggctcatagccctgagcactgacaaggctgttcacccggtcaatctctacggcgcaacaaagatggtagcggagaaactgtttatccaggggaatgcatattcaggtaagaaaacaacccggttttcctgtgtcaggtatggaaatgtggttggaagcagaggaagcatcgttcccttatttaagatgcaaaaagaagagggaaagattactataactgatccccgtatgaccaggttctggcttaccctggaccagggtgcagcctttgttgaaaattgtacccagattatgaatggaggagagatatttgtgcccaagatccccagcatgaagatcaccgaccttgcagaggctatagctcctggtattccccatgagtatatcggcatcagacctggagaaaagatccatgaagttcttattaccgaagatgaagcccgccatacccgcgatcttaaagaatactatattatagatccggagatatcgttctggaacgggcatagaaaggattattcttacacactccctgaagggttccggtattccagcgagaccaataccgaatggctggatgaagagggattaaagcagatgcttgctgaatcccacccataaaggatttttaatccaatttcatttatgcatgaaccggcatgcatttcccctgcctgacaaaagacatccggattgagtcctcctgttcatattcttccggagtgaggagaattagatcaagtgggacattaaattttctcactgtagaccattctgcctcacttaccattggtattctatccagaatatggacattttcaaagtcgggtgtgatgactgccagatcaatatcactatgctgagagattctgtttttagcatatgaaccaaaaagaacaatcatagtaaccctaatcccagactcttcaagtttcctgcagaaccagtcaattacctcatctactgcctgagtatccaatcaagcacctcctcagttcgattaataatatcttgtacacgttcctggctgtatatcttaaacaattcttcaaggtcaggaggatatcggattgatatcgatgcggcatttaataactggattgttgcactgatagaatttggaatgagcatatccagcttgactgcaattgcaacgagcgagtgtattttatcaggctgttttctgaattttttaatatacaatcctttaagtgctttttcaatggcttgttgacaaaagaagaccgcatatggataggtggaagattccgacatgtttattgcagctgcaatgtcaaaattcgcctgtttataccattcttcagaattacatgtcataatctcgcctaacccttcataaccggttttacaatgtattgttgtaatcaatcaagtatattatgctttaaaaagtcataattaacttgtatattcttattacatccatgctaggcaataaaagtagggtaactcaacaaaaaaagaaagagatcctgtgaaacatgtgtaataataacgtaatcgcgacccaatatctatgcaaaatatgacctatccccttccatacggcaggcaatggatcgatgacgacgatattaccgctgttatcgctgctttaaaaggagactggctcacccagggccccttggttgagagctttgaacagaagattgcggaatatgtcggatcagaatatgccgttgcatttaattccgggacctctgctctccatggagcatattacgcagccggggtccgaaccggagatgaagtaattaccagtcccatcacctttgttgcaaccgcaaacgccggagtatacctgggtgcccgtccggtgtttgtagacattgataagaagacatggtgtattgacaccgataaaatcaatgaagcaatatccaaccggacgaaggttattgctccggtggattttgccggatatccggttgatatgacatccattcgggagatagcacaagaccattcttgcatagtggtggaagatgcagcccatgctcttggggcaatccggggtgatgtgaaagttggtactgaagcagatatgacgatgttcagtttccatccggtcaaacatatcactaccggagaagggggtattgttactacaaataaccgggaattcgccgcggcgatgaaacgattccgaagccacgggataacaaaagatccagaattacttcacaaaaatgagggccaatggtactacgaaatgcaagacctaggatataattaccggataactgacattcagtgtgctctcgggctctcacaacttgaaaaacttgagagatttgttaagcgccggaatgagatcgcccggatgtatgatgaagcattccgggggaatgaaaaactggtgaaccctccaaaacctccccaaaattcccgccatgcctatcatctctatccggtctgtttcacaggagttgataggaaaaagatcttcatggaccttcgggaaatagggatcttctgccaggtccattatattccggtccatctccaaccatattaccgtgagagatttggatatcacgatggagattttccagttgcagagaatttttaccaaagtgaaatatccctgccgatgtttccggcgatgagtgatgaggatgtagaacgggttattgttggagtgcaggagatgtttgaaaaaagagtatatgctgacttaaaacttgtttaacactatctctaactggtagcatcaccaataattgagaataattatgcgacttgcaatcatccctgcccggggcggaagcaaaaggattccgcgaaagaatatcagggatttctgcggaaagccaatcattacctggtcaattgaagcggctctccagagtaaatgctttgaccgggttattgtttcgacggatgatgaggagattgctgatgttgcaagaagatttggggcagaggttccatttctccgtccggccaaactggctgatgattataccgggacggcagcggttgtccgtcatacgattgagtggtttgagggaaatgggatcttatacgaggaggtatgctgtatctatgcaacggctccttttatcagggcagaagatattcaatccggtcttgagaaacttcattcaagtaatgcagactatgctttcacggtaacgagttttccgttcccgatacagcgggctgtaaaaataaatactaccggcacacttgagatgttctatccggagtattataatacacggtcccaggatctcgaagaagcataccatgatgccggtcagttctactgggggaaagcatctgcttggaaagagggagttatattattttcagagagatcagttccgattgttctgccaagataccgggttcaggatattgatactttggaagactggatccgagcggagatgatgttcaagtgcatgtaatcaacaatttatgatatatcgtggattgtcatttcttcgacatcgaatttttaatcataagtgtaaataattaaagaagaggtagaatgaaatcatataagacagatcaggaaaaattttgggctggggaatttgggacggaatacatatcaagaaatgcaaatcgtgattctatttcaaaaaatcttgctttcttcgctgctgcattaaaacatactcgtaatattaatagttgtattgagtttggagcaaatattggaataaatctaaaagcattaaaaatacttcttcctaaactaaatcaatatgcaattgagataaatacggatgcaattaccgaactaaataagtttcttcccgaacaaaatattttcccgcaatcaattctagaatactcaccaacaaagacatttgatcttgttttaatcaaaggtgttctaatccatatcaatcctgaatatctggaaaaagtatacaatttgttgtacgaatcatctaatcggtatttattaatttgtgaatattataatccatcacctattgaggttacttatagaggccatcagaaaagattgtttaaacgagatttttgtggagaaatgctagatctatatgaagatctcattcttaccgattatggttttgtgtaccatagggattggaattttccacaggatgacattaattggtttttattagagaaaaaacaatgatgatccttttttcataacaaattttggtattattgagagaacgaaattttctatccaatcattacaaaaatatgtttaattctttaataataatccgcaccgatgcatctaccgctatcggcacgggtcatgtcatgcgttgcctcacccttgccggagttttgagagatagaggtgcatcggtctcatttatctgccgtgaacatgatgggcatctttgtgaccgcatcgaggagcaggggtttatagtccatcgtttaaggaaaggtgccgatcctgtatttccatctccggcgtttgatccatatcatgccccttggcttggagtctcatgggaagaggattccgaagaaactcgcaggataatatctacactggacagaaaaccggactggttaattgttgatcattatgcattggatgagagatgggaaaggtatctccgcccatatgtttcccggatctttgttattgatgatcttgctgaccgggtgcatgactgcgatcttcttttggatcaaaacctggttgaagggatggagacgaggtacgatgaaaagatcccatcctcgtgtggaaagatgctgggaccagagtatgctttgcttcagccgatttattcagaactacatgataagatcccccctcgtgaaggtccaatcaggcgaattcttatcttttttggcggggtagaccagaataacctgaccggaatagccctttccgcagtaatggagttgaaccatccggatatcaaggttgatgtggtcatatcaaaaaaatcccctttttataatactatccgggatcagattgttggcagaccgggcatagtagtacacagtaaccttccatctcttgcacccctgattgcgaaagcggatctagcgatcggggcttccgggacaacgtgttgggaacgattgtgcctggggcttcctaccattgtgataactacagcagagaatcagaaagccattgctcatggtcttaaagagcaaggtctagttaaatggctaggaaatgctgataccgtaacagcaaatatgattcgcgaatctatttctaaactgttgtcaagaagggatattagggattggtcctcacagtgctcacaaagggttgatggccttggggtaatgagggtttttactgcacttacgatatctccggatacagcattacatgttcgacgtgctaagctttctgacgaaaaaatattgttatcatgggcgaatgacccattaaaccggaagaattctttcacattggatgagatctctccagacagacaccatcaatggttttatgataaactccgagatgtagagaatgtttttctctatattgttgagagtgaggataaggttcccatcggacaggtgagatttgaaagaaaaagtgaaatatgggaaattcattactctcttgccaccgagttcaggaaccgtggagtaggaaggccccttctgaaggctggtctttgcgcattcagaaaagaacatgaaggggtaataatatttggaagagtaaaagaagagaatactacctcatgtaaagtttttgaatcacttaatttctcagccaaatctgacggggggggggtggcgtatcagcgtctgctctgatgttggaagctggatgaacgaatatatcccggttttaatctttgattggatagatgatggtcatgaagtgagatgggcacatgatgcagcagaacttcccgcgggagatatgtgttttttcttgagttatgagaagatagtagataaaaatcggttgatgcagcatcgaaacaatcttgttgttcacgctagtgatttaccgaaaggaaggggttggtcacctcttacctggcaaattcttgaaggaaaagataaaattccagtaacgatatttgaagccggagaatcagttgatagtggacccatatacgagaaagcttttgtatcattttcaggtaatgaattgattgaagaactgcgttgtggattagcgaatgaaattgttgatttatgtagggattttgtcagtggatatccagatagtgcaaaacttggactgaagcaagaaggtgagccatctttttatccacaccgtggccctgaagatagtaagattgacgttcagaaaagccttttatcacaattccatctgttaagaacggtagataataataagtaccctgcttggtttgagtataaaggacgtaaattttttcttaaaattaccgctaaaagcaatttagataatgcaaaagaatgactggtgaaaattatgcaaatcggtagatccatcatcggaaacaatcaccctccatttatcattgccgagatgtccgggaaccacaaccactccctcgatcgggcacttgccattgttgaagcagctgcacaagccggtgcccacgcaataaaactccaaacatacaccgctgacacgatgacactggatatcgcagagggagaattctttatcagcgataggaatagcctctggaacggacaaagtctgtatgatctctacaagcaggcacataccccttgggagtggcatgcccctatcatgaaacaggcagaagaactcggccttatctgtttctccaccccatttgatgagaccgctgttgagtttcttgaaaccctgaatgtccctgcctacaagatcgcatcatttgaagtcgttgatcttccattgatacaaaaggtagcagaaaccggaaaacctcttattatctcaacagggatggcaaccgtcgctgagattgatgaagcggtccggactgcaagggatgccgggtgtcgggatctggtcctccttaaatgcactagcacctatccggcaagtccgaagaatagtaatatccttacaattcctcatatccgggagttgtttgattgtgaggtcggtctgtctgatcatactatgggtatcggcgcagcggttgcagctgtcgctcatggtgcaacggtgattgagaaacattttactctctcacgggcagatggcggggtggatagtgcattctccatggaaccacatgaattccggattctaattgaagagacgagacgggcctggcagtcacttgggtgtgtacaatatgggcctggtgaagagggaaaaaaatctgtgatttttcgacgatctctttatgttgcagaagatatgcaggcaggagatattttcacaaaagaaaacctgcggagtatcagaccgggactaggattgtcaccaaaatattataggacattacttggaaaacaggtgaacagggatttaaaaaagggaactccggtaagttgggacatacttgtttagtaaaaaattaaaaagtctcctcattattctttcattgaacagaatacactcgtatctcccatggagatttttcggatgagtaaacaccctctaaagataaacccttaacaactggatcaatctcaactgctgaaaagatgtatttccctcccagatttttgaaagcggtaatatttaggtcaagatcctgaagaacaatcccatttccctttgaataagatgttccatcgagttctgatgagaatatatacgccctggatccccagccatcgaaatatacacgccatctttcacttttattcaattcaggggctattatttccctgaattggtgtttatattgaagaagataattagcaaaatatccatcgacggtgtaaaacccattatactgacttattgccgggtgaatcccgattgagccaacccgataactactttggtttattccgatttcatccctgatggattcaaaaacatcaggtgaatagaactcattgaaagaatattgaccatcctgaagatttccataaccaccagtttgatatgtacccccctgaaatgagaataaaaagattatctgaatcagaatcactccataaacaaagatttttaattttttggatctttccagtatgtaaatagaacatatcccaaatatgagataccaaataactggtaataatgtataaaaccgcatttgcagtgcatttaaaacaaaaaattgtgatttaataaaaaggaataaatccaacgttgaaacttgatatataaatgaaaaaagaaatacaagagttgttaatccgacaataatccattcaatagttaaaaattttccttttgatactcctttaagatgaagtccaagaagaagaaaaagaaagaaaattatcgaactccataagaaaagagtgattaaatctccattcacacgggacgttaaatgagaaaggattaaacctcctgataaaagggtaccaaaatagataatatatcgattaatatctctctttttccctaactggtgaataaccatcagagccaaagatacccataacacgggaacaatgagctgatgcaggctttcagcatgatactgtccggaggaaagcataccataacctgtctgaaaagtatcaatgaaaggtaacccaatagatgaaaattcgactcgatgagagatggatgaattatttaaaaacatctcccagaatagtcgataatcacaaattaaaaaaaggagacccgcgaagaatatcgcataaatacctctccataaaacttttctttgataaaccgaaatcaaaacgcaatacaggaatagaatcgggagtaagaaatatccggtaaagaccccgcttgaatagaaagaatataatattaatggcagaagtgaccacaatctccacccatctcgaatgagagagaaaaaaccatataacatgagcggtaagcctgcaatgctcaatccagcaggtggataaaatggcaataatgcaaatgcacaagagaccccggggattaaatatcgatactctttccctccgggataaaactcacgcagaaagaaaaacatcccgatgaaagcgatgagatggatgatagaaaaattcagaaaatatgcagtgattggttcgaagaaagtaaataataatgttacgacattaaattcagatggaaaagaattccgggaaatacctcccattatctgctcgattgttccatcatatgatccaaagagttttccggactggccaagaattaaataccataccacattagaatcaaggcagtcatgattgagaacaggtgcatcttcccattgaatcagaactggtgcaatatagagaagaacaataattaatcccaggagaaaaggtaaacgagaagaatgaattattttgtgcagatattgtacgtatgaggtttcagatccggtcataatatcatctaaagtggacaaaaagtataatcagaattcttataccggttatatcatccagcataaaataatatggaaatatcttcatgactttacaaatacctctcaccatcttcctcaccggcggctccggattcatcggttctaattttatcaattatctctttgacaattgcccggacatctccatcatcaactacgatgccctcacctacgccgcaaatcagaaagcgctgactcaacaaaaaaataacccaaactatcacttcattcacggtaatatctgtgatctccctacagtcactgatgcaatcaccaccacaaacccggatatcatcattaacttcgccgctgagtcacatgtggaccgaagcatcacagacgcatcgccgttcatctcgacgaatattcagggagtctacaacctgcttgaaatatgcagaaaacacgatgatttaaaatttatccagatctcaactgatgaagtatatggaacactcggtcccgatggtttcttcacagaggcaagcccaataaaaccccgaagcccctatgcggcaagtaaagctagtgctgatctcctcactctcgcatggcatgagacatatggtctgccggtgaacatcacccggtgcacaaataattatggcccctggcagcacccggaaaagctgatccccatgacgattcaacgatgtcttcaaaaagaaaagatcccggtctatggtaatgggttgaatgtccgtgactggatccatgtatcagatcattgttcaggtattgctacagtgatgcaaaatgggaaagttggtgaggtttataatatcggctctaaaaatgaatggaagaatctggatttagtcaaaaaaattatcaacataacccgggatcttacgggtgatccaggagtatcggaaaatttaatatcttttgttcctgaccgacaggggcatgatttccggtatgcgattgatcccgataagattaccagagaacttagttggtgtccaaagattacatttaaggaaggactggttaaaacgatcaggtggtatctgaaacaacaagaataatattaaggcccgaaatctaaattatttgtgataaaaatagatttttaaataattattgaaaaggatgaagagggggggtatgttgtgtctgttccatctcttcccggttgtatatctcagggaaaaactgaggaagaagcgagggaaaaaatcaccgaagcaatcgaacttcatcttaccgctttggcacgcgatgggattcccatcatacctaatttgaaaaaaactgaaagttttgtgtcagttcaaatatgaaacagggaaaattacccattctttccggaattgaagtagtaaaagttcttggaaaaatcggttacgtggtaaatgaccaaaaaggaagccatattcacctccgtcacctctcccggagaccagtaactgttccaaatcatcctgtaattgcaagaggaacgcttcgaatgataatgaatcaagtagagattattcttgaagacttttggaaattatttaatttaaaggatatatcgaattttggtcataaaatggacacattatccataatggaaaattccagacccgatagatccctacagcaacaagatcgtggctgggcgggattgaaaaaggttttcagactattcccagaacagataattactcaagatgtaatagtataatcatatatgactccttcttcaaaaccaaaatcgtcctcctcatctgaagaaactatcatagacggcctctgtcatttgaaaaagtctggcttatgtttcaggaaacaagtaaacagtttaaggagacggatagaaaattccaggagactgatcggaagtttcaggagactgaccgtttactcagtgagaaatttaaagagaccgataaaaagcttaacaaactggaacggcttttcacctctcaatggggtaaacttgtcgagtctctggtagaaggagatattcttacccttcttaaccaaagaggaataaaagttactgacacgattaaacgaaggaaaggccgtcgtgacggaatcgattatgagtttgacattattgggattaacggttctgaaattgtaatagttgaagtaaaaaccacactaaggccggaagatatcaagcattttctaaaaaaaattaaacaggcgaagaactggatgccagaatacactgataagaaaatatacggagcagtggcattcatatctgaagatgcagggacagcagcattggctgagaaaaacggacttttcgtgataagagcgacaggagatagcgcaagtattgtgaacgccgatgactttgttccaaagaattggtaaaacctgggaatttttactcaatatctatcggttttaatatcaccgcaaaattttggtactggcctcctttagaactgaacatggtagtttaaaaactcactccaattccaaagatgatcagtaatactttctaacattgctggagacttgtgactactttttacttcgataaaattatgcacaaattgaaagatatttagcgctgaaatgaatctattgagtttttttgaaaaagaggcagttttccttccaaaacggctcaatcgttgtctgattttattattgtagccctcaatgactgaggtagagattgctttactatctggatttcccataattttctctcgaatgacataaacaagtttattcttctcttttactttgatcacctgaccataatccaagcatggctcacaatataattcaggtaaacaaatgctatattggacgtttccatcagtaaaaatcgatattttgttttctggcgttggaagttccattcggttaaaaaatcgaactaacatatctgcacaagtatcaatatttctttttccagattcaaatgctaaaaataatccagaatcccttttaaaacaagtataggaccaacaatcacctaattcttcagagtcagttgttaggagattcttgtttttttttgaacaaactcccaaatttcatccatctcacaatcccccgcggaaatgtcatgaataaaataatcgttgagtttttcagcatgttcaccgattaagtgataatatcgagatatagtgtcgcgatggtgtccggtaactcgagatactcctcgaattgaagttttttcagtcgagtgtttcgcaattatgagaacagcagttcgtggtaaacgagaatcatacagaggagtatttttagtttcaataaaaaaacgtcgacagtgatggcaatagtactgttgattgcctgcagaattatgcccatttttagtaatattctttccatcttcaatttgaaaataagtacaatccggattttgacacgtaatcaatataggaccacgttttccaaccatgaaaataattatatctaaacttatattaatttttagtacataaaatttaatactttatttgcacttagtattaccagcttgctaacagggcactaccaaaattttcaatgaaaatgtggaccagaaggaaagatcagtatattagaaggtaacaatgatccagtgtcctgaatgtaaatccctctttaagacgggtaaacctccgctttgctgtccctcatgcaattatcaaattgaagagagggatggagttttttgtctccctgtctctggttctgatgagtatttcttcccgacagaaggattttctctcctctataaacatgaagcaaagcacttctggttcagatcaagaaacgaaattattggagcatttttaaagcgatacctcccgggcaatgctgaccatacaggtgatggtgtatcagaggtggatttccttccgcaggtgtgtgaagttgggtgtgggacaggtctagtttcccagtatcttacaagaatggggtaccggatgacttgtgcagacatgtttttggagggcctttcctttgcaagaaaacgaaattccggagaaaaattcttccgctgcaatctctatgatcttccgttttatgatgagtttgatgcagttattgcttgtgatgtccttgaacaccttgatgatgatgagttagcacttcaccgactgtatcaggccataaaaccaggtggcatctgtctgatcactgtccccgctggtgagtcactctggtccgctattgatcaatatgcaggtcataagcgaagataccatgccaaaggattaatgaagaaggtatcattggcaggttttactccgattcggctctcgtattttatgacaatcccttatcccatccttctgattaaaagaatgcttttagatatctttctattacatagcaatagagagggagaagaagattatggggtggatgaactgatgatcccgggggttcttaatgaactgctttatcacgctttatggcttgaacggaaattgatccacttttttgatctccccgttggcagtagtcttatctgcattgcacaaaaacctgtaatgaaatgaaagggataatccttgccggagggacgggaacccggctttatcctcttacgaaagttaccaataagcatctgctgccggtgggcaaggagccaatgatattaaatccagtcagacaactcctctcagcaggcatcaaagatattcttgtaattaccagtaaggatcacatgggagcggttgtccaactcctcggaagtggtgccgagtatggatgccacttcacttttaaagtccaggatactgccggcgggattgctgatgcactccttcttgccaaagggtttgtgcatgatgaaaagatggttgttatccttggggataatatcctgacctcaagtatcagtccgtatgctgttgcgttctctgaacaaaaagaaggtgctatggttcttttaaaggcagttggtgatccggagcggtatgggattgctgcacttgatgagcacaagaagatgctcctgtgtatcgaggagaaaccatgtcagccaaaaagttgttatgcggtgattggggtatacctctataatcctgatgtgtttgatgtcatccggggcgttagtccatctcatcgtggtgagcttgagatcagttcggtgaatgactggtacgtaaagcagggtctgatgaagtatgagtactattccggggactggactgatgccggaacgtttgagtcactggtgtatgcaaatgagcttatgctttcaagagataatatcatagagaattcttcatgaaaattccatttacccgcccttatcgaaccggaaatgaacaaaaatacatcaatgatatcttaacgaatattcagaacggagcaccaataagtggtgatggaccttacggaaaaaagtgcgaacagttaatggaggagaagttcggggcacggaaggttcttctcaccacctcatgcacgagtgctcttgagatggctacccgtctcatcaatatacagcccggagatgaggtgattatgccctccttcacctttgtctctaccgcaaacccggtggtaatggctggaggaagacctgtttttgtggatatcgacccggttacactcaatatcgatccggcaaagatagaagaggcaattactccaaggacgaaggctatttatccggttcattatgccggagtgtcctgtccgatggatgagataatggccattgcaaaaaagtacaatgtatgggttgttgaggatgcagcacagggggttggtgcgaaatacaagggtaagtatctcggaaccatcggagactttggttgttacagtttccatgaaaccaaaaatataacctgtggtgaaggtggagccctcgttattaaccgggatgaccctgacctaatcgagcgggcggagataatccgggagaaaggaactgaccggagtaagtttcaccgtggtcaggttgataagtatacctgggtggatgttgggtccagttatgtgcagagtgaaattctggctgcgtttttatttgctcaactagaggcaatggatgaaattaatcagaaaaggatggagatttggtataaatattatacccagttaaaaccgtttgaggagtcgggagtgatcaggttaccggtaattcccgattacgccgaacataatgcccatattttttatgttttgttccaggaacagagtgtgagagatacggtgatgaaacaattacaggaagcggggattcatgcagtatttcattatatcccattacattcctcaccgatgggacagacatttggttgccaggatggtgatttaccggtaacagaagagactagtggtcgattgctaagattgccattatttacaggaatgagtaatgatgaggaaaatttcatattatctcgtctgaaacaggtggttgaggaattaagacgtaataattaatttctttagtgttagtgatcttcatcggatagggttttttttaaaaataatgataaaacctgaaaaaacaagaacgatctaaaacgttgtttgtatcactctcattaaattattcatggaggtgaattactgagcatgaaatatgattcatttgaaaaaatcggtattggtactgatattgaagaaatccggcggttcgagaattttcaggagagacaatttagggtatttcttgaaaaaaattatacgaaaccagaattggaatactgcatgtctaaagatgcacctgctcctcacctagccgcacgttatgcaggaaaagaggctgttatcaaggcactctatagtcttaatgtcactcatattttttatccagcaatagaaataattaataacgaatcaggagtcccaaatgttagaattaattcaaatgagaatgaaaacctccgcataaaactaagtctttcacacagttccagtatggctctagcattctgcattattcaaaaggagaaataatatgacatgttatgatgaaaaaaaaatagaaaacatattttgtgaagttctgggactacctgctcgggaggtaaccgattctctttcctataactcatgcgttcattgggattcattaaaacaccttcagttggtggctatgcttgaggaaacatttgatatagagattgagatggatgacatcatcgcaatggagacttttggaaaagtaaaggtaattttacagaagtatctcacataacagatatgaatttcgtcgattatctctttgaactaaaaacaaatccctcaaaagagtgtattctgtacaaggatggcagtatcacatataaagaaataaaatcacagattgataattttgcggcttatctttctcatactattggttgggggaatgaatgtcttctgctctcataaaattctcctttttttataattgcctaccttgcaattttgaagagtggaaatagggcacttctcatggagacgtcaatatcagacaaatctctgacaagtatcattaatggatgccgtatctctgctttttttgtccagaagaaatttttgtcaaagttctcaaacaatgaaaaaattcttaccgaagatctccttgttactcttccaacttccaaattaccaaatacaattcatgtaagggataacgacgtagcggttgtgatttttacttctgggagcaccggcactaagaaaggtgttatgttaactcacggcaacctatgtgctaacactgaatcaattgtccagtatctcaaactcacttcccaggatcgtgtctgtgccacacttccctttttttattgctatggggcgtcattgttacacactcatctccgaatcggaggaagtattgttatcgctaaccatatcttccttggtggagttattcgggatatcaattcttttttctgtactggatttgcaggtgttccgagcacctatcagattcttattaataaaactccatttttaaaagaggatatgcccacacttcgatacatgacgcaggctggagggcaattgccgaacaaatacattaagataattgccgaagcttttccgcaaaaggagttttttgtgatgtatggagcaaccgaagctacggcaagactctcttttcttccacctgataaagtacttactaagcttggttccataggaaagggcattccaggagttactctcgaagtaattaatggagacggaaaaacagtacagtcaggggagactggtgaaatcactgctattggtgataacattatgaagggttactatggagatcctgaaggtactcaaagtgtcattaaaagtggccgtctccatacaggggatcttgcaactgttgatgatgaagggtatatctatgttatcggaagaacaaaaaacatcatcaaatccggtggatatcgtatctcccccaataaaattgaagaattcatctgttctattgatggagtcaatggttgtgtagtactggggctgcccgatgaaattatgggagaggccgtaatcgctgttgtccaaccaggtaaaatccctgaatcatccttgagggagcagatcctcacacgatgtacgcaacatctgccatcttataaaattccaaaacaaattttctttattcaagaatttcctctcaatgcctcgaataaagtagataaaaagacactcgctgcaatacttgagcgaagaaaggaggtaagagaagttgccaaatgatcttacaaccctatctaaagaggcagtaactcgtgaggaaattgtagccctagctccatactcgctctctgaccgggataagaatgaatttcttttatcgattattaaagaacaactgaaggttgccaggtgtaacaatacacacattgataattatttcaataaatgtggcatcgatatcaatgcaatacaaagactggaagagataccttatatccctgttcagatgtttaaagaatttgatctcaaaatctgccctgaacaggagatcgttaagattctaaactccagtgggacaacaggtggaatccccagtaaaattcctctggacaaagccacaactcttaaccagataaaggcgttaaaatcaattcttgcagattatctgggtaataaacgaaggatatttcttgttatcgatcatgaaggaattaacaaaccagagatggccttttctgcacgaaccgccggcgttcggggattaagcatttatgcaaaaaaaatcttctatctcctgaaagaagaaaacgggaaactttccctgaatcttcctattattgaagatatcgtgaataactattcatatgaagacgtgtatgcttttggatttacttatattatttggacgatcttttttgaaaaaataagacagggaaatatcaggtttttatttaatgatttcaggttgttccatgggggaggatggaaaaagatgcatgatcttgctgtttctaaagaggttttttcagatagaattgctgaaatcttttgtacccaatcaaagaacatcctcgatttttacgggatggccgagcagacaggtatcatctttgttgattgtgaatgtggcaacaagcatatacccgctttttcacaagtcattatccgtgatccttacacccttgatacctgtgaaattgggaagaatggtctcatagaggtgatgagtatcctcgcagatagctattatgatcaggctgttttgaccgaagatattggggtcatgataggtgtagatgactgtccctgtgggcgcaaaggtcgatatttccggtttgtgtcacgggttgaaaaatcagaacctcggggatgtggcgatacatttcgggagtctgacagatgatcacctgccatctcatgaacggaaaatttgaaacgcaaaacactgaaaattttgacgaaatttctcatattatagaaaacaagagaaaagcacttgccgcaataccacttgacgccatcataaaaattctcgatgttctgggaaaggggattcttaaaaaacctgaaatcaacactcatcccggggtcagttatatctcactatggcttcgacgcgaaaaccttgatctaatctgccgggttaattattctaataaaggatacttggatggttttttacaaaccgagacgaattttttgatgatggcccaacctcgtgggatcgtatgccattggattgcagcaaatatgccaacgctgggatttttttccattgttcaggccattctttcaaaaaatggcaacattgttaaaatgccggaagtgtttgtccccctaatcctttctatcctccgggaactcgtaaatatttcagtaaattataatggtgtgacctactctggaaagactctccttgatacgatagcaatagtgacctttgaaggtaaatctgcccgcttgagtgagaaattttctcttgcaggagattgccgggttatttttggggggagtaaagcagttcgtgcaatatctcttttaccctgtaaggatcattgtgaaactattatttttggaccgaaatattcatttgctgtatttgacaagcagtatattgaatctgactcttttaagagttctctcccaatgatggtaaaagatattgcagttttcaatcagatggcctgttcttccccccatgtagtgtttatggaaaaaaataagtacccgataatgacgattgcctcgtggattcaggatacctttaaagatttgcctgaaacactccgcaatcaagagatctcgaccggtcactcttcgaagatcataaacactcggactcgttacttactttctgatgaaaagaactgtattgctccaagtgatctgagttggaccatcctcattgatcaggagatctgccttgaagaaccaatacaaggaaaatgcatattcatcaaggagataaattctattaatgatgtaatccccctggtgaatcataagattcaggcaatatcagttggaattttgaatcaggaaaaacgagaagtttttgcccgggatattacatctcaaggtgtggatcggatcgtaaatcctggcacgatgcatgacttcactcagccgtgggatgggataatgactctgaaccgtttggtgcggtgggttattttaagaaacaattgatgaggtaaattacatgctcaatggcaaagtgatgttaataaccggggccagcagaggaatcggacgagcaaccgctctacttgctggagaaaatcatgcaaaggtcatagtgaattatcatgttaacagcgaagcagcagacgagttagttaatctgataaaacaggatggcggcgaggtaataagtattcaggcggatatttcagacggcgaagatgtcaagcgtatgttcaggataatcaaagagatttacggccatctggatattcttgtaaacaatgccggaataatgaagaataatcttcttctcatgactccatcagaagaatttgatgaaataattgcaacaaattgcaagggttcttttttgtgtatgcaatatgcagcaaagatgatgatgaagaagaaatccgggaaaattattaatctttcttcaattgttggagtcaatggaagtgatggtcagattgtctattctgccagtaaagcttttgttattgggatgacaaaatccgcagcaaaagaattaggaaaatttggaataaccccacattcgccagatcttttttcaactatagaatttttcgtactccggcccaagcaatcgcaatatcttcaatagttctcgatccaaattctggatagatgaatggagtgcatcattgacagaaataatacatgacttaagagggtgttgcacaactcagatccccccataattttttaactaaggtcaatcaaaagtactttaccttagtacgtccaacatatactcaatgtataatacgataggtcgggattttgaacaactttaccttctccctgaggatattagagactgggttccgagtgatgatttctgccatatattaattgatttaatctcaattctcgacctatccccattatataaggaataccgggaagacggccaaggtgcggcattttatcatccagaaataatgactggtttgatcatttactcatattttaatggagttcgttcaagccgtcaaatagagaataaatgcagatacgatgtaggatttagaatagtaacccgcaattctctcccagaccattccacaatctcgcgatttatcaagaaaaacagttcttttattggacaacttttcattccagtattgactctccttaatgaagcaggattaatcaataacgtccttctcgccttggatggaacaaaactaaaggcgaatgcttcacttggatcgaacatgccatatgaaaagattgagggagaaattcaaaaatatctaaaggaagtccaagaaaaagatgatgtcgaggatcgtctttatggcccggataaatcaggtaacgaggttcccgatgattttaagactcactcaaaaaggataaaacgattcattcaagcaaaagaacgacttgaggctgaacataaggagaaatcccaaaaaaaggaagagaagattgcccaaagggaggaagaggagagagagtctggaaaaaggaaacgaggtagaaaacctaaaaagcctgcaaaaaaccctgatgagcaaagtcttgcaaacactacagatcctgatagttcaataatgaaaagtgggcctggttgtattcaaggatataatggccagataattgtaaaccaggatggctatattctggttccgtttttaagtaattcacccgttgattacagattacttcaaccatgttatgaaagattagaggaaattgctcaattaaccggcttatcgcttgaatatcttaatttacttactgatgctggttattggagctatgaaaactatctgtatatgaaacagcaggatattggatttctctgttctacatgccatgaaccagatattttcagtattagaggcctcgagagaagtttacttgaacttgaacgaatttccgatcaactttttgatggcatttgcagtattccaacgttagcatctattggtgattggtgtacgagaaatctcattcaagatgataatattccaacacccgcttctattgctaaagggattatggaagtgacaatgactccgtatggtgccaaaaagacatattcacaacgaaaaacgattgttgaacccgcatttggatggattaaagaaaatcgcaatttaagaaaattgcagagaaggggaatatcacattgtcaggatgaatggagtttgatttgtttaacacagaatcttcggaaggtctgttcaagaggggagttgaagaaattcagagaactgatcctgcaaaagaagcggcatattatctgtaataagggagtgggtattagaataccttattcaatattgtccgatgcattatcatctttgggcagaatgatcggagacaattttctaaagatgttgataagaaaaagtacttaccaaaaattttccaaattttagtcatgcaacaccctcttaatctctctgaatttaaaaaaaatccatttgagcgttggacgagaggtaggtttcttcttctgattcaacaccgtttcatcttcttctttcagcctttttcgcagcagcatttcagtatatgagtaaaccatgaggcagagaaccataaccatacataaagcctcgatccttttttcacttttcagataaacttcagcaacccggaatgatttgtcctttaaaaaccggaaacctttttcgacaagcatctgtcctttatagtgattcagaaccgtttcagaatccaaactcaaaacattcgttgcaagaataaatctgcccagatactgtttttcactttcaacgaaatcctgagcaagttcaacccttgcatcgatcgaatattgtgggattaacgtttctcctgcttttgggcgccccttcttaccattttcccgtttataactgaccttgatccttgaatccaccaattttactaaaggtgtttcattaagatagcgtaagagagcgttattggcatctgtttcacatgcatagcatactttagaaatctgttttaacccttttaatgcggctttgaacctcacagggaggtttttctcaaacgtcttcaattctcgagctttcatctcttcagatgagacaacaatccatttttgaggaacaccaccataatgtgagtcaacgctactgcaagaataccgtggatctgaggtaggagtgaagagaagatcagatttgagtaactctgtcatctcatttattgtggctgggacatttgatatccaccttgtttccggaccgagggttttgatgtttttatcagtatacagggcactgtcacccatgaagattacatcaggatcaaatgtgaatgaatcttgcaatgataggattgtttgcacaagaacttccttatctgattcgttgccatcgtgtgcacgagcaaaaatcggtatcccgtgttggttaaccaccatacttaaggcaaatctgtttaaatcccagcgtttgtcttttggatgtccctttgtaattttgatacatccatctccggattcatttccatattcaccatgaacactgaaattggttgtatcaacatgacaaagctgtactccatctttgtaaacagtaaacatctgggtgacaagatcagtaaagagcttgctggggccatatgcatatatcgtatccaaaaggcgaccaatgactgattcatttagattttttgcagaaatatccggacctatgagacgttccaaatcaagatgcttgcagtattcgggaaaaagatagagtcgtctctctgtgaatccaagtccgttgagaatgagggctaataaaatttgagaacttgatatttgatgttgaccaattttagggattgcccggtcaattataggagctaaaccaagcttatggaacgtgcctgcaacgattccaagatgatcaatggtttttatggagtctatttctaatgaaacatcctcatctttcattaattatagtaatggggatcttcttagttatatagtttactattatataaaattgtaatagatctgacgaatatgggataacagtcaatgcggtggcacctggttttattgacacagatcttacaaaagatgttaaggaagaaaagaagcaacgattattgaataatattaatcttggtcgtattggtactgcagaagatatcgcaaaggtaattgttttcctgagttcatcatctgctgattatatcagcgggcagattataggtattgatggttgccagataatttaaaataaaaaataagcgggatattttttcctgaattctatcattttttctttatttccattaaaatgctattactaagttcagggtattcaataccaaccttacacatacccattaatatttctgatgatagttccaattttcgtatctgttgagatgtgataggttttataaaaataccttcgattcttgtgatttttaagttatgcgaatggacgaaatcagtaagagttttaacagtaaagtatctctggtgaccgaacatcaaatcatcatttgataatttaaacaaatcatttaacaatcctgcctcatatccaatcctgcgatgaagtgattcggcattaggaaccacaatataaatggcaccccctgggtttaaaaaatctgcatatttttttaaaatgagatctggatctttcacatgttcaaggatataacccattattattagatcccatttttttggcgaattaaaatcttcaaaaaaacaattatgaaaaataatttttgattcaggattttcgatttgatattttttaatgaagagcgatgaaccctcaatcacttcataatctctaaaaaaattatcaaaaaaatcagttgtttttccatgacccaaccctaagtctaataacgattcattaccagtcgatgcagaaatttcaattattctacggggataccattccatagagagttgattgtcaatccagtgttgatttgttgtactatatccctcttcatattcatctaaataattatccataaattcacccatatcattattttattaaccaattaataatttgtctaaatattccgtctttttttaagtccaaaattaaaatgtccttttttctgaatacagaatttttaaatttaaattgatccacattgactaacaaggtagttatttacatactttttcgcaaccaatatttgataccatatgaattatatcttatatagataaatcggttattgacttaaaataaaattttttggatgggagactaatatatgaacgaaaatctaaacgtattttttctccagtttttcctatttaacgctcattagtaattgaatcttcataaatggaaaagtgatttctatggaaaaagtggtaatttttgggaattcgtcctttgctcagttggtatattattatcttttgaacgattcagttttcgacatcatgggttttactgtggattcagagtatatcaaagaagatcaattttgtaatcttccagtgtttccatatgagaaaattgaggaacaatatccaccatctgaatataaaatgtttatcgcaattggttattcagtagttaatacaataagagcgcaaaaatatcatgatgcaaagaaaaagggatatcaattaatctcctatattggttcaaaagttaattattggccagatttaaaaattggagaaaattgtttcattcatgagaatcctactattcaaccatttgtagaaattgggaataatgtaataataaatggttcgagttatattgctcatgattcatttattaaagatcattgctatatcgcgggatctgcgtgtattggaggaatggtaacaattgaaccatattgctttgttgggatgaatactactataaaagatcatgtaattatccgaaagatgggaataatcggtcagggttctgttgtaaattcggatactgatgaaaaaggggtttatagtggaaatcctgcaaaaaaaatttatcataacagtttaaaagtcaaaatttaatattttcctaattcaattaattaataacgaattcaaaaatgaaagcggcaattattcaatcaaactatttaccgtggaaaggttattttgatataatccacgatgtggacgtatttgtttttcttgaggatgttcaatatacaaaacaagactggagaaaccgaaatagaattaaaacacctcatggtccgaaatggataatagtcccagttacaggagggattcatcaaaaaatttttgatgtcaagattgattattcatcaaattggatcgagaaacaaaaaagacaaattgagcactcatattgtaaagctcattattatgaaaattataaaaaagagcttttagatatttttataaaaaattttgattctttatcagaattgaatatatttgcaataaaaaagatttcaaaaatattaggaatagaaacgaaattttcaaaatcaacagatctaaacgtagatggaacaaaagatgataagttaattggaatttgtcaaaaaatcggagcaaattcatatatgtctggccctgcagcaaagaattatataaaaatagacaaattttctaatgcaaatatcgaacttgaattcaaggactactctggttaccctgaatatcctcaattgtggaacggatttgaacattcggtttctattattgatttaattttcaactgtggagataaagcaccgaattatatttgggggtggaggaatggaaaacaatgatgactgtattcaatattcaatcgtcattccagtatacaatagtgaaaaatctcttgaggagttagtcaatagaattctttcctcaatgtttttaataaccgaacaatttgaaattattttgattgatgattgtagttatgatgatagttggaatttattaaaaaaacttcatcaaacgacaaataagctaaaaattatccacctccttaaaaattttggtcagcataatgctttgctttgtggtttttcttacgctaaaggtgaatatattattgtaatggatgatgacctccaaaattctccagaagatattccgatattaattgataaaatttgggagggatattctgttgtttttggtaaatataaagttaaatatcatagttcgattgaaaatttttttagcaggagataccaaggatttatacaccatattctggatattcctacagacatatttatttccagtttcgtaatactaaaaagggatgtggtaaaaaatatgatttcgatcaaatcctcatatatttttttacctgcattgatgcaaaaaagcgttccaacaagaaaaattactaacgttgaggtaacccataacccaagaaaatatggaaagtcaaactacaatatccgaaaatatttatcactctcactaaatctcataataaactattctacactcccattagtaatgattggactcttcggaatcttcatcagtctttttagccttggttacggattatcgataattggcaggtatattattgatccatcatatggagtaatgggatggaattcccttatggtcgccttatcatttctaggagggactattttattttccatcgcaataattggtgaataccttcgcagaatccttatggaagtttcatacgggcagcaatatgtaattgatgaaattgaactttaaaatgaaaacgggtctaaatttctcttttatcattctttcgatattattccagtccgctagtggaattattgggaaatatgcaacactatctctgtcttcaaatccttctctaattgaaatattgacaaatatcttttatattctcggacttctttgcctggttcttcaagctattgtatggcagcaggcgttacgctttttttcgttatcattcgcgtatcctttcatgggtctggtaaatttttttgtactcttatattcggcagttttttttcatgaaggagtgacgtttttcaatattgccggtttgatctttattttatttgggatacttgttctgtcacaagaaatggaaaatgcatcatgacattcatcttcttactcttgttccttactgttttttttacaggcattggtcaagtattgctaaagattggagcaatgtataagggaaataagaatgattctattttcaccgcatattttaatccatacactattattgcatatggatcaattttactagttacaataataaatgtatatattttgaaaataatacctttaaaattattatatgcaattgcatcacttaaccttgtagttatagtgttgttttcatggcttttattgcatgagaaagtgacattaaaaaagattggagcatgtatacttatttttttagggattatcatttttaatatcccttggtaatgcaaaaattggtacaattcaggggtaatatcatatagaaaaaccccgaaatggaaaatgactatacccagttaccggataccggataccagtctgatgtaccataaataaaggttttatcgattgatgcatcccagacattgtttccgtccatatccagataccacgtattaccattgacaactcctatttcggtaataccatcactgttccagtctccggtaaacggaagccagccagttagaccaaagacagaactcgcatccagagatggttcccagatattatttccgttcaggtccagataccaggtcttgccgtctgatattccgatctcacttttaccatctccgttccagtcaccagcgacaggtttccacccggatgctccaaatttaaatgttttgtctgttgatgcatcccagaccgcattgccgttcagatcaagataccaggtatccccatttacaacgccgatatcggttgttccatcgccgtcccagtcaccactgaccggaaaccagccggtaagaccaaagatgctggttttgtctatggatggatcccagacattattcccatcaaggtcaaaataccaggtcttgccatctgatatacccagttcggtgatcccatcgccattccagtccccagacacagctttccacccggcggaaccgaagatggcagaaaggtcactcgaagagtcccagacattgtttccgttcagatcaaggtgccaggtcttgccatctgacataccgatcttactttgagtcccggatctggtgattctaaatccgtttgtcagactgccggattccatgttcgtattggtgaccgtgatattccagtaggagttacgcagaacaacctctaaaaaatttatagcgcatattttgggttctgaatatattctgaaattccaacttttatgatttgccattgagcatcgtacggagtaacaccattcaaaaatttattgacttcgaatcgtaaatatgcccgaagtgagcaattaatatgatttcgttggataattccctttctagcttggcatttttcgacaccacatagttctttgatagccctatgataattctcgattgtccagcaaatagattgtaaaaccagcctatcttcattattcatcggcaaaaaattggttgcccaatatctacttacacctttacgatttagtgagtgaaaaagacgaataaatccatatttctttaaatggacttctaatccctcctctggtatatttaatgatgacacttgaacattaccttgggcatcgggattgaccatacgatttttcttaactcgtgtgaaataaaaccatccaagacggttaatcaacttcaaattttcatttccggaataccaactatcaaacatgacaaaggcaggagtaaatcctcttttgaaagctgtcaaggccatttcttggagatgatcatttttggtcttatcatcaacatccttatcataaattcgataatcaattggaaatgaagtgattccatctgtccaaattaaggtaatcaatcctattcctttgattactttgtgctcttttccactccactggtaatatgtacattcgatttttttggaatgttttttatctagaatagtgtcatccagaaccaaccagcccctttttctgtcaacatatgcctcaacttcagcccacaacgtctcaggagttagagactgtcttgttaggaatcgattgaaggtatcatgtgatatcgagaattcagacgtcgaataacaatcagcgacttttacacaagaaacgtcgcatcgagctgcgatgaggtaattgatataatctacatctgaaggctgcttcgttataggcacgtatattataggcgttgtcaatatatatagatctttctataataaaagttaactgcgtaactcctataagagtagaggttctaaagacctgttttctggtaagtgttgggtgccagtattttctggcaatccatctcttccctttattattatgacggcgctttgcccatctccacaacatatttcggacaacccagtcaagtttcccaaaggtcatacttgcagaaaccgtccggtgatacattgcccatcccttaattacgggatttagggctttgataaggtcttcctgtttccaggccttcgccgacttaatgattacccttactttatcaatgattgcggcaatagctttcttcgaaggttgtatcaggaatttgcctttgaattttctgaaattccagcccaggaaatcgaacccctcgttgatatgaacgattttggtcttttcctcagagagttcaagccctcgttcatgaagaaattcagtgatgagttccttgcactggagtgccgtttcctgtgagtctgccgttacgagaaaatcatctgcaaaccgtatgagatgaaccttatttccgggaaagtgttctttcaacattctttccatgccgtcaagagccatgttagccaataagggggaaattaagccgccttggggcgtacctgacttgttacggtagagtattccatcataaatatagccggctttcaggaattggttaaggattctttggtcaagagggatgttatcaagcatccattggtgtgcgaaattatcgaagcacccgcggatatcaccttctaatatccattgacctgaagtctttctgcttaagcactgaaaagtgtatgaagcagcatcctgtgcatttcgcttcattcggaatccgaatgatgtcttgtctgctgtggtctcagcccaaggcataagagccattgcatacaaagcttgcatagcacggtcatacatggttggaatcgaaagaggtcgcattttactcgattgcggtttagggatgtagattctccggagaggttttgcccgatagcccttgtccgaaagcgttaatgctgctttcattttctgttcaggggtggtccatttttccccatctactcctgcacttcttttacctctgtttttggttactcgttgtactgccaacatttttgcataaaacgaatgtgtaagcagatactggagtcgtcttgcaagtcgatattggccgttcttcactgcttttgcgatacgtgtctgaagtcgctttacataatctcttgctttagcaaatggaaatttcttccattgttttgcaagttttctgtccgagatgtcctcgcttttatgcgtaattgaacttatcccgttcattgaaaccatcctgttcgccgtgaaaaaccagctgcacgtcggcaccctttcaggtcagggcaaagtttgaacccctatccacagccattacagccgggcattcgcgttttgcagcctcctactcccactacgcatgtggttcctctcacaaggttcttacctaaaaaaaatttttttttttaggagcgtattgggttttccaagttcaataaatcggataattgtggtattttaggacccgcccatagaccggaatcagcttcgtccattcgtaccagcataattcaaactactgataccgtgattctccctcagtggggacaggggcaaatctctttcctcctgatataattaacgatcctgcagcggttcaacgtttgtttgtccatgatacctttccctggcagcttatccaaatgagactatgggaatcaccacgtatgttcctgcagcttcgcacccgtttattactaaacacgcacgtgcaggtagggacgcccagaatggattgggtggcgttaccggttttaagccgggttcgcaatccgatttactgcttcttgtcgcacttaattgtattcaattcattagagggattaaaacgaaccaagtctccggtagaagttttttctacatttggagaaactgacaaaatatcttgagaaattgaaccaaataattgctcttcagtagatttttttgtaagtgactgagaattatttaaaagaagatacgattgatatgctgtcgttttatctgaatttgcgcatgattttgacagaattttttgagacccagtacctaaatcaacctgaacatcagccataactaaagaattgataaggataacagagggtgttgcaccaatgatcaatatcatgcaggatcacaaatgatcgatctctaccccttaagctatcaaccaaaatagactaattgatgtatgaacctgcatgtatcaattcccactttacatactgtgtttgcaaaaatataggaaaaacctgaacctcttgacggttttataatattcgtagcaaattctttaattttaactataccctcaaatctgataagtttttttatattatgcactaatgcagctaaaaagaattctccctcgcaattctctttccctttttgagagaaactcctaaacctcatattatgtttcatattaccaaaaactggttcgaccatgtattttcgttttcgatataactctctaccagtgggggatttcacacgtacttccataactcgtttacaaatttcctgagttgttgcttgtttctctctgttcataaaagattgccaaacaaacgtcccgatactttgcaattccggaaatgtgattatttctcccatacaaatcgcccgacatatcatttccattcgtgagatatacccatcattatctgaatattctggaatttttctttctttagaaggagggatgatgagttgaatgccataatccaattctgctaaagaattcgggtatgagaaataacctgcatcagatagtagtatattaggcgaaattgatggatgaatacccgtaaaaaggtcttcgagttcatttagcataggtattaataattttttatcgttttgctcatctgatatcattgcagcgaggataaattgattttcagaaacgataatctgcccattatacccttgaatccagccattggtggttgacattatctgactttcaggatcagtgagatttacttttgaatctgaagatggctcttttttaggctctaaaggctttctacctcgtttctttttacccgattctaattcttctttttcgcggtccagaatcttttcttcttgttttttagattcgatatcatgtcgttcaattaatttctctttagcccgattaagaacttcctttcgtttttcttttgttgaaagatgctcaggtagtcggttaatctccatatcctgaatatttatatcatcgttttctaactcatcaatttcctgtgattcatcaaaaagccgacctagctctgcttcaaggtattttaattttttattggctgataaagaggcattacagccaaattttgatccatcgagggctaggacaccgattcttgctatcccggattctacgataatttgagataattgtttaaaaagggatttgatttcttttgaattattcttcttgaaacgatagatcgttgtatggtcaggtgtaagattattggcgacgatccgatatccaatatcataatggcagcacatctcaatttttctgctagatttttctccacgaatcattgaataaattattattccaagcattgaacgaggatcaaaaaaggcagaaccgcgaccatcgtcacgatatttattaataaatggactaatatcgagaatcgaaagaatttctaatatgccataagtaatatcattttcagatagccagtccatcgcattgacagggagtaaaaattgttgttcattaccatatcctctaatcatgttatagcgatgagacatataatatattgatcttaataatatatataattaagctttaataatttatattaagctttttttgtgtttgtgcaacagcctcaacaattaaaaaaattaggaaaaaaatattcttttgaaccattttaacaatccatgaagagaatatggagaattgaaatcctccctatccttctaatctataaaaaaaaagatttgtgcaccacatataaaggagtatcgaaaatatatattgagagcataatatagaagcgagaatatgaaaggtgcaataataattttctttactttttcccatgaaaaaaccggatcttctagagagtatagccctcaaatcagatcaggatctggtatttcatggaaaaatagttatgaaatccattctattccaggttcagcggcaacatatggtctgaccctgatattatcatagaatgcctgacctccggttgtccagccaaccagacctagtcggtcagtggttgttgtaccataatacgcccaatcagtgccgattttcactccattgacatatgcatcataatatccgttcccctttagatcaagccggacagtataccactgatttgcagtataactggtgaaatatgcccaggaaggagttgcagaaccgaatttaccattatttgcagcatagaaccatgcacctttgattccagaggcatgaccggaaaacgctgaaacagtatgatacgcagtggtctgggcaggtttgatggaatattcaataattccagaaccagcagtccaggatttatacgctccgctaccggcaacaccgtttgaagtaaaccgcccaaccttgtttgaaccctcagttacctgactcatcgtaacaccggagtccagagtccagctggataaaacactctcttcgaagtcttcaaagacggagaagatagaacttccatcagactgacttgttgctccagcacagttataatatatactgaattgagttccggtactgctgatacttgagggttttatccagacaactgcaactccatcactgacggattctatccaatatggaatttgtgaacctccggaatcagtaaaccggatatcaccaaagtctgaacgaactgaactaccaaggtacacagtattcccactatctgtcccgcttgtccggtaaagggtgagtttgaatggagtgttggtaactgttgagcctgttccagatgagacgataaagatcttttgattctgccagtcagcagggaaactgggaggagcagagactacaatcgtttttgtgattgaactgggtgattgtccataggtagaactgaccgtgagggtgacagagtaggtattcgcaccggtgaacgtgtgagacgggttttgttcggtagaactaccactgtcaccaaagtcccagctacgagaagtgataggtccagtggacagatcggtgaaggtgacattgagtggatactgaccgcttgtcggagtgaaactaaaatcggccatgagaggagtgctgggatctatccattcgattcccggttcagttgaaacataaggcctgacgcggatgttatcatagaatgcctgacctccggttgtccagccaaccagacctagtcggtcagtggttgttgtaccataatacgcccaatcagtgccgattttcactccattgacatatgcatcataatatccgttcccctttagatcaagccggacagtataccactgatttgcagtataactggtgaaatatgcccaggaaggagttgcagaaccgaatttaccattatttgcagcatagaaccatgcacctttgattccagaggcatgaccggaaaacgctgaaacagtatgatacgcagtggtctgggcaggtttgatggaatattcaataattccagaaccagcagtccaggatttatacgctccgctaccggcaacaccgtttgaagtaaaccgcccaaccttgtttgaaccctcagttacctgactcatcgtaacaccggagtccagagtccagctggataaaacactctcttcgaagtcttcaaagacggagaagatagaacttccatcagactgacttgttgctccagcacagttataatatatactgaattgagttccggtactgctgatacttgagggttttatccagacaactgcaactccatcactgacggattctatccaatatggaatttgtgaacctccggaatcagtaaaccggatatcaccaaagtctgaacgaactgaactaccaaggtacacagtattcccactatctgtcccgcttgtccggtaaagggtgagtttgaatggagtgttggtaactgttgagcctgttccagatgagacgataaagatcttttgattctgccagtcagcagggaaactgggaggagcagagactacaatcgtttttgtgattgaactgggtgattgtccataggtagaactgaccgtgagggtgacagagtaggtattcgcaccggtgaacgtgtgagacgggttttgttcggtagaactaccactgtcaccaaagtcccagctacgagaagtgataggtccagtggacagatcggtgaaggtgacattgagtggatactgaccgcttgtcggagtgaaactaaaatcggccgccaattgttcagttgtaactccacttaaccatcctccatgaacaggtctggtatttgtaaactttctgacacggatgttatcatagtatgcctgacctccggttgtccacccgacaagacctagacggtcagtagtggttgcaccataatatgcccaatcggccccaattttcactccattgacataagcatcataatatccgttcccctttagatcaagccggacagtataccactgatttgcaacataactggtgaaatatgcccaggaaggagttgcagagccgaatttaccaatatttgcagcaaagaaccacgcaccttttaccccggaggcatggccggaaaacgctgaaacagtatgatacgcagtggtctgggcaggtttgatggaatattcaataattccggaaccagcagtccaggatttatacgctccgctaccggcaacaccgtttgaagtaaaccgcccaaccttgtttgaaccctcagttacctgactgacggttacaccggaatccagagtccaaccgtttaacacactctcttcaaaatcctcaaagacattaaaaacagcactccccgagctctcactcactgcactccgattcccataatacatcacaatctgcgtcccagcccttggaatactcggaaccttcacccacacaaccgcagcggtcgcatttaccgactcaatccagtagggtatctgggcaccagcaaccgtagtaaaccggagatcgccataatcttcccggacattggttccaacatacacattctccccggaatcagtcccggtcgttcgccagactacaaaccgcatctgataattcgtcaaatccccatccggactcccaccaatcgcatgaatctttcgataactccatccactcaaaaacgctggaggacctgaaaccacggtcaccgtgctactcacataacctaacgactcaagatttatttcactcatattgaccggcgtctcggaaagtacagacgtaccatccgaatgcaccacacccgtcggaccaggcggagcaacaacaggcccactcactgatgggaccactatcgggggacggacagactcggccccggcaattccactacaggaaaccagaagaagagcgacggtaataattaacaacagaacagtataccctatcccggaagtatatgatcgggtttgacgaagcgcgtttgatctcatgatttttcctcctctaatacaagaccttgagcgaaatatggcgttggacgaaggtatagccagggatagagcacccgtggattgatacctgacatacgaaggaaccggaaaacgaattcaataatataagtatatgtagacatcatagtatgaaatcacttcagtaatcctaatgcaataatacacaatcattatataaaatcagatctgtgcgcaagaactcataaatagaataaaatattgcgaaacagcctattaggcaaccaacccctccaataccttatatagattatatcctctggcggaacaacagtattagtgccactcgattgaccgcagaaatccggtaccaattcccctttcctccgcagttccagagaccgcactaccacccatactgacagtcaccccgtcactgacagtacgggagacatcatatgtccccgttgtctcataggtataggttgtattctattctgcagatgatgttccatcaccaaaagtccaactccgggaggcaggagaattagcggatatcacgtaaaagttttcggaatggaaatcatttcgacatcaggtacttcacaggattttcaaatgtccggatcaataactcgcctcatgatcgtacatcaatttttcatgtaccatatcgcccatttggagcagtatccacgacattccatcttccaggcatatatcccttgactgggattgtgcaggtgatctctgttgaattacctatgacattagttgcattgacatcaacataaccggagtgtatcagtattattattgcacctgaaagaaaaccaatacggagagaatttaaatcctaaaacgacctcgattttgaaccgttgaagatataattcgggtaattttattttaattatataattagccttcaaaagataactgtcagtaaggtaccaggtagccccacaatcggggtttagtcaaatgaatattctaaccctcatcaattagacgagccttgaatagatatttcgcattataccgacaatatatcctgatatggttccatcctcaaagacaaattcatctccaccagctgacactgaatctatcaacagccccctttcattcgaaaaagtatggcttatgtttcaggaaacggataaaagattcaaagagacggataaaatactgacggaaaaatttcaggagactgacagattattaacagaaaagtttcaggaaactgacagaatattaacagaaaagttccaggaaacggataataaatttaaagagacagataaaaaactcaacaaactcgagcaattattcacctcacaatggggcaaacttgtggagtccctggtagaaggagacgtaattaaaattctgaatgaacgagggatagaagttactgataccctgaggcgacgaacgggacgacgtgatggaatagactacgaatttgatattatcgcaataaatgggacagatatcgtaatcattgaggtaaagacaaccttaagaccaggagatgttcgtgattttttgaaaaaactgaagcaggcaaaaaactggatgccggaatattcagataaaaatatttacggggcgatggcattcatatccgaagatgcaggcacagcagcaatggcagagaaaaagggactttttgtcatacgagcaacgggagatagtgcaagtatcatcaaccaggaaaactttcagccgaagatatggtaattcaccatatggacctggaataaaatccccttacttgtactctatcaaagcttaaaatcagttagttccaagtgcttttattcatgcttcaacttcatcagatagaaaaactttgaatagatatttcgcattataccgacaatatatcctgatatggttccatcctcaaagacaaattcatccccaccagctgacaccgaatctatcaatagccccctttcattcgaaaaagtatggcttatgtttcaggagacggataaaagattcaaagagactgataaaaaattcaaagagacggataaaatactgacggaaaagtttcaggagactgacagattattaacagaaaagttccaggaaactgacagaatattaacagaaaagttccaggaaacggataataaatttaaagagacagataaaaaactcaacaaactcgagcaattattcacctcacaatggggcaaacttgtggagtccctggtagaaggagacgtaattaaaattctgaatgaacgagggatagaagttactgataccctgaggcgacgaacgggacgacgtgatggaatagactacgaatttgatattatcgcaataaatgggacagatatcgtaatcattgaggtaaagacaaccttaagaccaggagatgttcgtgattttttgaaaaaactgaagcaggcaaaaaactggatgccggaatattcagataaaaatatttacggggcgatggcattcatatccgaagatgcaggcacagcagcaatggcagagaaaaagggactttttgtcatacgagcaacgggagatagtgcaagtatcatcaaccaggaaaactttcagccgaagatatggtaattcaccatatggacctggaataaaatccccttacttgtactctatcaaagcttaaaatcagttagttccaagtgcttttattcatgcttcaacttcatcagatagaaaaactttgaatagatatttcgcattataccgacaatatatcctgatatggttccatcctcaaagacaaattcatccccaccagctgacaccgaatctatcaatagccccctttcattcgaaaaagtatggcttatgtttcaggagacggataaaagattcaaagagactgataaaaaattcaaagagacggataaaatactgactgaaaagtttcaggagactgacagattattaacagaaaagttccaggaaacggataataaatttaaagagacggataaaaaactcaacaaactcgagcaattattcacctcacaatggggcaaacttgtggaatccctggtagaaggagacgtaattaaaattctgaatgaacgagggatagaagttactgataccctgaggcgacgaacgggacgacgtgatggaatagactacgaatttgatattatcgcaataaatgggacagatatcgtaatcattgaggtaaagacaaccttaagaccaggagatgttcgtgattttttgaaaaaactgaagcaggcaaaaaactggatgccggaatattcagataaaaatatttacggggcgatggcattcatatccgaagatgcaggcacagcagcaatggcagagaaaaagggactttttgtcatacgagcaacgggagatagtgcaagtatcatcaaccaggaaaactttcagccgaagatatggtaattcaccatacataccgggaataaattcctctttattttactcaatcaaagctggtgttgctgcatgaagagacctcatcatcctctccaaaagagtacaaacccaactgccctttgccttgaattcaggagtttaacagttttccaggagattttgcccattccagtacttcatgagcattccggatcttaataaccagatgacgaacagaatactgaagacaatcgaattaatggttattgaatcactcttttttaaatattacgcggaaaggaaggccatatggatacggacccggtgttgtatgtatacgcgaagatcatagtatacaacccgaatcgatcctctgctatcaattcggtcagctcctctatgtgcagtatcatgccattctccagccagaatacgagatctaaaacttatcccgggtatcaacccggcatattcattttgtaacacaccagttatccttggaaggtccagacccggaaaatcaagagttcagtattatcagaggtttcttgaacgtattcgggaaaatttattttatttgctcattagtgaggttgttgcacaactaaaatgtcatttcctcaagagcacaatttccattcggttggaacgttaattggcaatgaaatttatgaactttgcctcattgtactatcggtttagagttatgcaacagcctctagtataattttgaatttctccaaaaaatgaagatgtaaacatcagaaaggcgaatcaaataaagatacaccagaatactccttcaccgaaggaagaaatcatgggcctgtgataatccctttttagcgttgatttgcccgcaccattcctgcagaaaatacccgggatctctccactgcggaccaaaaccggacatccgggcatacacagaaccggcctaaagtcattggctttgtaaacctgaagaagaaccagttttggatcctctccctccgaagccctgcccgaaaaaaatcgactccaatcaaacctctgacgtgattcgagagataatcttaaaatttaaaattaaacttgaggtggggttaaataaatataagtatattactcatattcccaattttgcattacataaatacgggtatattaccatctattcagaaaattacgcgacaaagggatcgaattagatttaatatcagaactaacctcaattaacagtctgtttgcctaaaatccgaataataataagcatatagaggcacgctatcattacaggattcgccacctggaattccacgatgagaaagagatccggacatagcgacagcctatgaaagaggtctactctatccaaaaatgctatcaatatcaattttgagtggataaaatctatgttctgacctggcaaaaaccccagatttaaccttataggtccggatcacatcctccaagcccgaatcatcaacaccgatgcgatagacatcacaataaaaaaaaggttcgcgatttgaatacaaggattttttccgaataagatatttgacttctattaattgtttttctccgttcttcaaacctctatcccctctgcattccaatacgatgtgagttcgccacaaaaaggttgctttatccaggcattcaaaattcatcaaattattactgatatcaacctccaggaaataaaagggacttagagccccccgacctcgttcgaaactgagcttactccttgaactccattactgacctgcaatgtgacggtgtaggtctgcggattataaaacgtatgaaccgggttctgaaccgtggaggtgttcccatcaccaaagttccaggtccgggatgccactgatccctctgatacatcataaaacctgatagtcagaggataaaccaccgtttccggcaccccatagaatttcgcgagaacctgggacaccgcacgaacgctggtatatgcattgacccggcccccggtcacacatttcccggataaaccgctctttacatccacaccattcatgattgctgtctttatctgatccattgtcagcgcaggatttgctgccttaagtaatgccgcaacaccagcaacatggggagttgccatcgaggtcccggacatggtagtatatcgattccccggataggtgctgtaaatactcacaccaggagctgcaacatcaaccgtgcttgctccataatttgagaacgaagcgagtacatcgcgtgagtcggttgctgcaacggtgaggatattcgcatttggcagtgaaccgggtgagtgtggatttgtatcagtattgagtgcactgttccccgctgcacagataaacagagcatccggcatactgctgatagaatcctgaagagcggtatcaattccgcttccaccccatgaatttgagaagattctcactcctcgggagtatccccaggcaaaggcctcaatcgcatcactggtatatcctgacccggatgaatcaaggaacttgagtggcatgatcttcacattccagttcacaccagcgaccccaataccattgttcccgaccgctcctattgtacccgcacaatgggtcccatgaccgtgatcatccatcggattactatcattattccgggtatcatacccggcaatcatatttgctgctaaatccggatgattatagtcaaccccggtatccaccacagcaacaatgacatcagatgacccggtcacataggaccaggcttcaggggcatcaatatctgcatcagcagttccccccgtctgtccggtattatggagaccatacagggaagagaacgaaggatcatttggaatgacctggccccctggtgaaacagcagtcatcgttgcactgacgggtgtcgtttgacctgaagtgaccgacacactctgtgaccagtcctgatacccggttttggtcagcctgatcgtatgagttcctgccggaacatcactcaaagtggtaggagtggtaactccctttgcctcactatccagatacacggccgcaccagtcggatttgaacttattgatatcgatccttttggaactgcagtaagagtggccgatactgtcgcagtcccaccggatggaactgtaaccgaggtagaataatctgtatacccggtcagtttcaccgtgacggtatgggatgttgcagtcacggatgtgagggtattcggagttaccttccccgtattggccccgtcaagccagatctgggccccggacggactggaggatacacttattgatccagtctgggcagttatcccgtagttgatgttgaagattgaaaagtaatgattctggtacccctgggacgactttccgctgtagtccatgttcatcttaagtctgaaaagaccattcgggcgcttagaattgctgccccagctgttcaggactaaccagtaccgctggtttggatcactgctggtatcatcataaccgactatgacaaccgcatgaccacctccggatgatccataagcgatattgttatacggatccggattccagagagtcgattcggtctgatatgcccaaaatgaattaaatgcagaccacgatgaactgtccggaaggaaaaacgcccaccagaccgctttgtttgcatcgatctgtgccttgatattggcaatagcctgtgcttgtgagactccgtttgtcgatatccagctggtggaaatgctggttatcgggtagttcggagaggttgcaatacttgaggcaggggtctgtgccccgcatccatatgagcaggcataccggtcattgtaataggcattggtatttgaccaggggataacctgtttaaatccggaggtgctgtggaaatttgcaaacgtgctggcccatccgccattgcatgcaccggttattgcacttccgccattataattcgaatcaaaatattgtattgacagtcgatcctttatcccattctgaacggtcagggcattctcgataaccccggttgaagcccatacccagcagttcccacagttcccctggttccgctccgatggggtgtactggatattggaaagaaggcttttactccccaacgtggtagagagaggcgcattttccaccttaacagcggcattgtaatcgctctggatctgtgcaatatcttcaagagacaaccgcatgtatccaaatccttccgtctcattcatcgtagaaatggcaccagcagatacactggatggaggtgccgagggatggtcattctgatcagagggtgcgggagatggccctccagagggggtactcaccttaccctgaacaatagaatcacggtatgaaacggcattctgatttacattcacggggatgtggatcttttcaaccggatatgcctgatacacataatccggctgtgcatactcaaccatcgggttcatccggtacagctcgattgctttcatggtcccggtagagtttggaacactgacgacctgcataccctccacgccaagagtttttgaatcagctatcaccgtggcacccatggctgcatgtgcttctgcctgtacctggcttaaggatgacttttcagagcctaaagcagatttaaacttaacaataacccggtcaggtgcatattcagggctctccaacgaattattaagagtattattcatggacaatccactctgctctgttggcgtcagacctgacattgtactgctcatcactggggactggacaatgctcataactggtctactaaccggtgggccagccacttgcggtaccggaccgactatcgatggcggggaatgatatgttggaactcccacatctggaggtttgaccaccgtcgatagaacgggagtaaatggatctgaagtcgccgcaaccgtatgtaaacccatactgataatcaagagagaaatgaaaatgaatgttagttgtttcatcatgattgatcaccctcgaaagttaagaattaatacgcaattattatatataatagtgtgcatgcgcttcatgttttatatgccaagaaagattagagacatcctattaggcaacgcccatacgaatagattaaataccgtcacagattttacaatgatatccttctgttttattcgaaggatggtaaccaatatcttccattttttcagaatactatcaaataattacatagctaatccggatttcactgctatacctctgctcggaaaaaaacaaattttggaagaataatgaaatcaacctccctgtatctccagcacagaggcatgagtaccaacaccgtcatttacctgaagcgtgacagtatagatgcctggattataataggtgtgcgatggattaacttcaccagtagtatttccatccccaaagttccagagtcttgaggagattatcccttcagagacatcatagaaccggattcgaagaggtttgattgttgtatcaggaaccccgtaaaactttgccttaagtggaagggaggaggccagactggcgaacgcattgatccgacctccggtaacacatctaccagatagtccggatttgagatcaacattattcattatggcggattttatctgggatgctgaatatgaagggttctgtgcctttatgagggctgcaacacctgccacatgcggggtcgccatagaggtcccgctcatggtgccataggagttgcctttggtagtactcatgatagacacacccggtgcagcaacatcaaccgttgtcgcaccataatttgcccaggaagctctttgatcatatcggtttgttgctgttacagagagaatattcacattagccagcgatgatggagaatggggatatgaatcagtattatagggatttccatatatatcgccatttccggccgcacatacaaagagtgcatcgggatagagattaatggaatcacgaagagcataatcgataccataggctccccatgagtttgagaaaattctcgctccctttgcatatccccaggcaaaagcctcaatcgcatcacttgtagagccatacccgtcagctccaaggaaccgaagaggcataattttcacattccagttcaccccggtcacaccaatcccattatttccgactgctccaatcgtcccggcacaatgagtcccatgaccatgttcatccatgggatttggatcattagaaccatagaaatcatacccgggagtatttgttaccggatccctccagatatttgcgaccagatctgggtgattgtaatccacaccggtatcaacaaccgcgacaataacccctagtgaaccggtggttatgctccatgcttccggagcatctatatcggcatcacctgttcctccactctgtccggtattatgaagtccccacagactgctaaatgaaggatcattcggaagaacctgggtgccagggttaatttgattcaaagttccggagactatacttgtctgaccctcatgaaccatcacaacggtcgaatatgaattatatccagagagaaccagtgatacagcatgtgaaccaatcggcacggaagataacgtcgcaggtgtgctctttgtggtatcaaccccgtcaagccagatccgtgcaccggaaggagttgaactaactgcaatactcccggtaggtattggtgaaagggtggcagatatgacagttgtctgtcctgaagttacagataccgaacgagtatactcctggtacccgctgagtttcaaggtcaccgaataggttccgattggaactgatgtttgagtatagggagtaacctgaccggtgttcaccccatcaatccagatttgggccccggatggattagaattgaaagcaatcgtcccgccagaaggatttgaggctgtatatttaaaatatgcagcaccttccccgatacggagccttcctgagaaaattctaaaccaccctgattcgccccaggatgtcccccaactgttcttacaaatccagtaagtccggccatttaacgttccccatcccacaataataattgcatgatttgcataggatgcactggacgtactgtcaagtatacctgatcgatatgaatcaaaggtgctctctgcatagactccggcggcaaccggaccatagagataaatcgccgtctttatcgcatcatcagatgggatactccactcattccctccaccgacatacccccaggtctctcctgcggccgtatctaccgaatacctggtatacccggacagactcttacacgtaccatccgaaccggtatagggatagttcgcctcggtaaccgtcccgactccaccactcaaacccgccttatttacaaagtatgccattgccgtgaagagtccgccattacatccacgctgatcacctgcacagttcaccaggtactgctcagcataatcagggttcatacccggatttccggattttatctctttatatgattcaaaggcaccggttgttgcaaatgcccagcaactcccgcaacttccctgattcttaataggggtggtataatctccaccattgttccgccagtcaaacgaagtgggaagtccttccattggtgtgataccggcgccactcactatcgtgctgcttttcagatcatgccggagtcctttcagatgttcacgctcttctggactcatgagcatgattggatttaccgctgcagtccaggagagattatgttctttcacataggcatttatgtcatccacttctgcttgtgctgcattatatcgctcttcttcgctcaacggatcttcaaatcctactaccccgctctgatatcccgatgataaacaggtcgaccaggaaggcggtgatgatggaggaggaacattcggaacctgaactgtagacggttttacctgaatagtttcaggataggggactgtctgctgatttacagacaccggaggatcaataattgttgaatttatagaatacaggtaatccggctgggcatactcgaccatcgggttcatccgatatagttcaatcgctttcatggtcccggtagtgttgggaacactgacaacctgcattccctcaacacccagagtggatgggtctgcaagaaccgttgcgcccatggctgcgtgtgcctctgcctgaatctgatttacagaagataagggagaaaagtggtctgtcttaaactttacaataacccggtcaggaatatatgcttgtgcacatacagaactattttgtgtaatgtttgtagaagggagtaattgttcaggttccaccttggaggatattatacctgacagaactggtgactgtacaatgcctgataccggcccatctccttgtaaagttgactttggagtgactgggattacaatcgacggcagggaatatggaggagcgacaccactatcaggaggtttcatcaccgcctgtgaaccgggcaatatcgtaactgatgttgccgctcccgactctaaaccgatacttatgagcaatatcagaatgaatattaatactattggcttggacatgaaaagtacctcgaaaaaatatgatccctattacacaactattatatataattctggttaagcgctatttgatttatattgtaaaagtggtttttaatctgcctattaggcaagacccccagacagattataaatattgaagttgctatgaacagtgactgggagagtatttaaaaagttcttaaaattttggtatatactttcaaaaatgggaaaacagggtcaaatgttatatatcaacaggaaaaaataaaagaaaatagttatttcttcttcttatccatcgcctgctgcttgaccaggtttcggatcctatccgcagtgctccccttgaaatccacaaggtcccgttcatgcacagtcatggtcgtttcagatgaaggtacatcggtgattgcatccgctaacacatgatccagtttcttcgcccgttcccagcattcgagcgcctcctcatttctccccaggccaccggagagtgtgatggccttaaatgcccagagatcagggttggacggatatattgcgagcgcctgatcatatttgtccaccgcttcctcgtacttcccctggtatgccagttgatctgcctccaatgcaaatgcatcagccttattgaggagaacatcacgcttgctaaggaatttgtgggttgaattttctgccatatttctgattctttcacattaggtggggacagtatttatgctttcacccaaaaaatcccagaccatcatttcactgattgaatcgtattcaccgtttgtcgaatatactgcctagattaatgggcaactccgaaatttggaacagcagtcggtgtcgcggatgtgagcaggaacccaatcttcggagaacagaatcagcccgctccagaaataactgaaaatttatgaggctgttgcataactctaaaccaatagtacaatgaggcaaagcccataaatttcattgccaattaacgttccaaccgaatggaaattgtgctcttgaggaaacgacattttagttgtgcaacaacctcttatatatatgactcttcggtgaggagccagaaccagaggggaaaatacgtaattttccggtcctgaaagatctcttcatctaatatatcagaagtaataataatcccctcaccaatctcaaaataattcattgcggaaatcagccctattttttctctttcacgggtcatcggatctgaaatatcaacagagacctgaataagccgaatggagtcatccctggattttatgacaaaatcgacctcaaatcctttttcatcctgccaatagtatatctctttaccctgacgaagcagggctatgtatacaatattttcaaatattctcccaatatcatttgaaaaccaaaaagagactgcctgcatcatcccatggtcgatgcaatagagctttttgggcttttgtatttgtctttttaacgacgtatcgtagtgattgacagaaaaaagcagaaatgcgtcttccaggtatgagagatatctaattattgcatcagtactcaggctctggtaatcagaaaagagccttttcaaagaattatactcaccgttcgctgatcttaaattcagattcctgaattgatcccaattgagtataaacactaatatcaacattcatcagatttaaaatctctcgatgcttttgatttatcccagtaattgtgtaaaaaacctgttcaccataaaatgaaactaacaaataaatctctttgaaaaactcaataattctttcagttttaggattatttactattttcgttggattatattcgaaaagaccactcaaaccctgacctctacttttcagcgaatccctgacttttttctcaataataacaagtggtctcattacaatagtcaaaaacttcactaaaccatcaattctgtcatctcgttgaataaacattggggcaagtgaaagtgcctttcccttcagccgatgaaattgatgctctatgatatactgatcacggtaagtcagaacaacatcttgcatcgataattcattttctggtttatttgttacatataccctccatcctgataattcctgcgcttgttgaagggcttgcaagttaatagttggtttaacctcaattctcgtcgattgttcaattctggcgggattgtttccgtattttcgttttggagtattactaatatgctcgatatactcaacttcgaataccgctgttaatcccttatctccaagaatagcatgtactttttcttttgcttcctcgattgttcggtaaattttctttccctttcctcttttattcattgaatttatctcaaagaaagctttttttacttgctcttcaagtgataatctgaatttatttgcatgagcaaatgattttgcgtagattagccgttcctcccaggttatgattttcccctcatattccattgaatgagatatttttttctcaaatccttcggctataatcgcatcgcttccatcatagtacgatcgtgaaacttgtgtgaaggaaagattagactcctgatgtgctatgattgcagaataaatttcctgagtaggatgagagacttctgataacgggcataaataaaagtcattattgatagtcgtatacaaacgagttgctatggcacccattttgcaatctcccacaaaaagtaatccagattgtcccgtagattttttcaccttttccattgcagggatatagagaggatcatcagcacaatttccagggactacactaacggtgaggggcaaacccagcacatcaagcactgaaagtacgatttttatttgagggagggaggcgtcatcttttgagttgccaaattgtattaatccgtttttatcgataattccattgctgtttactgttgtcatatcaagacggacgatgttttcatccgttaaaccatatatacgcagtgtagaacgatttaattcagattcaaatcggttccaaagttcattattgtgcaatagagataatatacgagccaaatggtcatcagtaaagcattttggactaaattgaaaaccaatcaatttttccagtaaattttttttggtagtaacccacttctccaagggacacatacgatgatcattttcggtcaggcagtagcagatccaaatggcaatcgtttcaccaatcggcaaacccacccagtttctgtgaggcgaatatacctcattcaaaattcgtatgatttgaagttcttttaatgtttcaaagatatatgggattccgccgatgtgttcaatttgatgtgtcggagcgatcatcccatatatatgtacacttctcagatataaagttaagctttataatttaacatttaccttataagatcagcgaaaggtaagttataggtatgaggtttcgcaatattggacacacagaaaagagctagttctttgaatattttcggatttcgcactccatgtcgcgacacgatatcccggtatatgatatcatcaaaataagattggagcaatgtaatgtgatctcctgcaggatagataattacttcaggaaatcctccccgaacaagatattcattgaaaatcctttttatctcgatcttcttatcagaatatgcgattgttttcagatcaaacgagatgtttttatatttcaggaattcgaaaaaactgaacggaaacattctggtggtaatgtgccttccagtcagccgggaagagatttcttctgacaaaagtgaggcatttgagccacttattacaaattttatattttttcttttatcgtagattccttttaaccatttttcccataaaggaaaattttgtatctcatccaaaaaaaaatagagtttctgatcatccgatgaggcatacagttcccgaaatgtatctattaattgagataactcatctccctgaataggctgcaatcggtcatcatcaaggttcagatagagaacagatgactttggaacaccgtgcatgagcaggtctgaaattaactgatacataaaataggtcttcccacagcgtctcacaccaataatgtcatgtatatgaggaagatccatctgaatcgggcgatttctaatgtgcacaaaaggcaatgcactctcctgccattcaacaatcgcagtttttagttttgcccgggtatccatgcaaagagattgaatatacaaggagatatgtctatcgcatatagacgataaattctaaataaattatcggatataaacgatagttatcccgatgaaaattctgcagaaacatgagatttaaaacctatattcattgcttataaaatacctcatttgttttgattataaacaatgaagtggcctcattacctttctgttatttgtgaaaatatttacgatcctgatacgaaataatcaatcatattatgactacaataaaaaataaaatcatcattcagggaccaaaagttcacgatgtgggatatagagtttttctcttaaatcgtgcactccaatcaggacttattggcttttctgcatttaatcatactttgccagataatatacagcagattgagatctgcatagaaggagatactgaatccattgaagagtttaccacagatctgcatgataatatccccgttcatgccatcgttgatacaatttccattgagccatacggtaagcgggtaatcacgataatggactatatgcaccttgtccaggttgaacaactggataaaggaattcctgcgattttaagtattcaatcatcacaggaaaaaatgttggagaaacaggatcggatgctcgagaaacaggatcaaatgctcgagaaacaagatgtgatgattggtaaacaggatcagatgctggaaaaacaggaccaaatgttgggaaaacaagatctgatgattgacacccagaaactgaccaacaaagagatacaaacattacgatatgacttaaaaaccgaaatgaatgaacgtttcaataaaattgagcatgaattgcaggaggtaaagaatgctctccataaacacggaatcatggcataaaatatttaggagatcccggaaagaactgcagaaaaacctatgcgaaatattggttattatcaattaaatttaaggtgtaaatattttaacttgcagaatgttttaaaaaacttatggagggttcgcctcaacccagaccgataaaaaattaccatgctccccctcaaaatccagacggtcccgtacatacatacgcaatgaaagtttcagaggaggaaccaggtgtgatttcatctgcaagaatgcttccccagtttttcctgttcacagcacataagcacctcaatatttctccccgggaacttcggcaatatctttaaatgtcaggtgggagggcatatctggggattgagaacctttgatttatgtgtatcaactttttattcgtctattccataaatctaccaactttcgccctttcgatgcgaatgttcagcccaagtaaagagactatcacacatgcgaagccctgtacggatcgatgtacccgccatacctctgattccttcaccccttgaagaaacacgactcatgccttcactcacatgaatcatgaccatcatatcgctgccgtcaaatacgatgatgaccaaataactcgatgagttcatggaaaataagtacgagatatcatcatcccttcagtcacttctcgaccatattgaggaacagctgggaacaacgatacatctctcacgaaaacaggaagccccacgaaaagggatactgcttgatcaatatacctaccagggatcacggaatgtcatcgcattttccaaccagcagatcggtatgctcaaggactttgtcatcgcgcagaatgcaatcaagctcctgcttcggggtattgcagcaaagaacaatggctataaagtcctctcctttgatgcgaaatctgctacctccggtatggaacagatctaccttgatgtcctgaaagatgaaaagacacgccacctggacttctggatcaagaaaaaactgatgttttacctgtacatgctctttcatgaatccatcatcgaacttccgtggactctgctctcaaatgtggtggttgcaaaactctgtccggtcatgcgaaacgcgcaggtctactacctcatgaaagagagcatgcgtgacatgcatgatctggtctcattcaaggattatatccccaggcgatattttgtcatgcataacgggatgttctttgcccgagacctgatgctcggagaggtcatgagcgagatgaagttgaacccgatgattaatattcctgaactgaagaagttcaaaaatctgaatctcatggagatgcttacccaccggtggcagaaaaatccatggtaccagaccaaacttgttggtgatgccatggtcaatatcttaaaggaactcaaggtcgcctcggtctgtgagcatccccgtccggagacgtattatcagatataccaggtgggagaggagataacaaaccggtggatacggctcatgcagattgagaaatattacttctgggatactcctgcccatcaggctgcggcgctcaagaatcaggaagagtacgagaaagaagcgcggatggcgatattcggggaagtataatttttgttgacggggtcaggattatgcttgagaaaatcctgtcaatgattcatcgtcaccggggatatattgagacaggaaagatactcttcattgctcttctggctcttcttgcattatttgtctcgatatatgtcttgtgggagagcccgtggaccggctttcggtttatttatgtcttcataccacacctctatctgattccaatagttctcctggccctctggtacccgaaatcagggttgaggttgttgggggttattctcctgtctattgttgctttttggatcttttcagatatttttgggtatcagttcagtattgcctttgtcatgctttatacgggtcttgacctggcaactatcatggtccttttgttatatgtgaaggatcgcagattggttgaggcggtaatatctgatcttatcgaacgggggggaagaaacaaggatgagaaagtatcaaaattcggcggagattttgatgcaattatcacggccttggggagcggagatgagcatgaacgggaggatgctgtcgaagctttatctgaactgtctgatcccaggatagtacttcccctgattaggacattaacggatgaaagtccgtttgtcagaagaatggctgtagaagcactcgggaagacaggttctttgaaagcggtgcaaccacttatgagggcactggcagacgatgatcggtatgtccgggaagctgccgctgagtcgttagggcgtcttggtgaggtagctattcctgatttggtgaggggggttcaggagaaagactggagaatccgggtcggatctctcattgctctccgtgtctcatccggagtgatccctacccttgatcctattcttgagcggttatatgatgagtcgccctatgtcaggcgtgaagcagtcaagacacttggacgtattggcaactctctgattgttccgtatattatccaggcgacaaaagatcaggatgcgggtgtcagaattcgggcgattactgctttaggaaaaattggtgagagagaagaggttatcccggtaataagccgatgtatgaatgatcccaatagtgcagtcagggtcagggcaagggaagaattggaaaaattgagaggagaatctaattgagaaaatcatttgagtcgcataaatattttattttaatttattttgctatccttttttcagcattaatcggcgtatctgttcgtctgatcccctttggcattattatcagtaatcacccacgacttgaaggactatgcgatacatggtttcttctcacacaaacagaactcgtggcacataattatccaatgtattcgtggttctatccttctattggattcccgcagggattagagactatagaaatgaatcctctccttcctttgattgctgctaccatcctgctccttacgagtggaagtggagaggtaacgaatatttcgataatttcatttatcccattcttttcctctttacttcttattccaataacgtattatttcggaaagatgatgcatgggaaatttgcagggatagctgcagcagctcttgtgtgtgttattccttctattcttataaggacaactcttggatatctggatcatcattgttttgaaattcttttttcagctggtttttgttattactttgtaaagttgattccggagatttttccagaaaaaaccgtcgaaaagatctcgaatggcgaaattttcatacgattaccactttctgcaataatcttatcagcattatttttcacgctgggaatactcaatgtaatcacaatgatggtcttttttgctattgtaatgattgtcctaaccatagcttccttatttgtagattcattaataatcaacaaaaagagactcattttaatttattatttaatctttctgccatcgacgtttattttaattctattaagtattataagtcaatcatccgtaatctttcgcacgtttaatcttcttgctttggcactgttgggcggaggcatctggttatggataattttttcaattccagaggtttttcaaagactatcattaaaacgattttttattttatttcttattttcctatccggattattaattgcaataacgaatttatttctaccacaatcctgggaactcatcaattatttttttgcttatccatatactttaaatcttgaatggactccgctcacaattgatggatttttgaagatgtatggtattgctctctttcccatatcaataggccttatttatagcattcatcagatatggaaattgaaaaacatacaatggatctttatcttattttggttctcttttttccttttcgctgcatttcagcatcaacgtcatttatattatctggattatccatttgtgatacttgcaggtgctggtctgaatgaaatctggataaacggaggtaaatttatcagaacattcaaactatataccagccaaaatactgatagtctgattcaggataatgctgatttaccttatgggaaaagtataccaccaagcttttttcaaaaaaattcaatcccgttatccgattggcttggaagaattttggcgattttcatttttttctgtatcatcctgcaattcagcagcgtatcatatgaatgggtaaaagatgactttaaaaacgatgttctcaatcaggactttattgatgcaatgatttggctgcagaataacagcccggataccgggattaatccgagccagatatatttagcaaatcattatgaagtaccatctgatggatattctcttattactccatgggtctatggatatgctgctcattattgggcaaagcgcccagtcagtacaagcgggaataaagagacaaacggtgccctgattgaatcattatatggatcccggaatcagtcatttacagatgaggtgatgaaatcactcggggggagatatcttattgttactgcagattttttaaatgatgaattgcccatgtatctgtatcgtggcagtcagataccgcccataataagtattgatgaatatctgagttttcttacagatacagacattacaggggaggagaaattctatcctgaattttaccagccattctacgaaactcttgccattcatctctatctttttaacggaagtcatgtgcaggggaaatttacagtaagaaatgctaaacagggatcagaatcaattctttctcccccatatgaccttgatgaattacaccatttcagactagtatacgaatcaaatacaaccgttaccccgtataccggaccagttcaggattcattaaaactgtttgatgtggaatcgtctccctcaaaagagaccgcgctggataagatacctcgggtaaaaatcttcgaatacaagaacattactgaaatccaggagaagggctgattgaaactcctttaataatctatcagggcagggattttgggtatataaaaaagtgccaatgaagtttcattaatcttttatcctttgtgaaaaaggcttaatttttttactggtgcaaatttcacaaacttgtaaagaaaaaaccattttaattacgctaggtgaatggagagtattgatttttaaaagaaaaactttcatgatgccatcaccataatactttaattagtatgatcaaaaagggattatatgaataatgaggatgggttttctggacttgaagctatgattgttctgattgcctttgtggttgttgcagcagtttttgcgtatgcaacgctcggatctggattctttgtcgccgacaaagcccagctatcagttcatgaaggaacaaaaaccgctgctgcatcagtttatcaagaagggggaatatatgggacaatgcatgaaacaactcatcagctcgataaactttcttttaccatatatgtcccggatgaaggtttagatcaggatctgaagcagatgatcatctcatatacccagagtgacatttcaaatccaaaagattatacctggagcgcaactgtagcagataattcacacttttttgcacaagggcttgatttacttaaagagggacaaaatgtccgcattgatctagcagatgtcaaggggccgacgaatggggggtggtttgctgttgagatccggccaaaacagggatccacattattaataaaacggtggttaagcgaagggtataatggaggagtaattatataatatttttttagggttgaactatttattcacttatgctaatctttattaccaattgtgtagaatataatcttcgttccgggtgatccggaaaggagtatcgtatatgagaaaagaaacagcattttccggccttgaagcagcgattgtgcttattgcattcgttgtagtcgccgcagtgttctcctatgtgatgctgggtgcagggttcttcgcaactcagaagtcacaagaagtaacctactcaggaatgaaacaggcaacatcaaacctgatacttgatggtatgatctacgggtcatattctaaaggtggcagtgggttagcgcaactttatttctatgtgaaggttcccgaaggcggagagactcaggatcttaaatatgtcacctatctctggactaaggagaacaaagccgttacaaccttgacgagtataactccaactaatcaacaattaaaccctggtgctcgtgttaaggtaacaattactgcaccaacaggatacaaaccaattgcaggacagaaatttgttctggaaattaaaccgaagactggagcatcaacgattgtaacaagaactttaagcgatggatataatggcggagttattatctaacttccttttttttcgaaacgtatttttatcagtttttagcacatcaatcaatttatacaattatagaggcttttgcataactaaaatgtcatttccgcaagaagataatttccattcgagtggaacctaaaatcagcgataaaaaatctggttttttcctcattgtaccagcggtttaaagttatgcaacaacctctgtattaacccatgttcttttctacacaatatttaatcacctctgaaaaccaatgcgaacggacaaaggaggataaatagtaatttcatgaatttaaaccgggtacatacccttatgattgttttatttaggtgggaccctaaaaaataaaataaaaaacaattatctacgataaatcgcacatccacacataataaaaattattactagaataaatattgtgaggttatctgaaagtcgtccaaagatcaattcattcggtgtggattgattatcactttcatacacacttaaaaattctttatacatctgtttggagggattaatgtcgattgcttttcgtaaagctcgtattgattcattatttctggcattatcatgcagtgatttggcataaaaaaaccaacccagatcatcctccggggcgagagcagtataattttctaatgctttaatggctaaagtatcattaccaaatgactggaaaattcttcctttaaaaaaccatggtttttcatattgggggtcaatattgattgcctgatcatacgctttcacagccaaatcaaatttttttatctgttcatatgacatccctagattaaacaaagttgctgaatcattcgggtttaacatagaagcattatgtagcagttcaacagcttcattgtaagaaccaagagcatattttactagtcctgaataaaaaaacaagtcaaatgaagaggtgttacatgcccttgctttcgagaaatattcatcggcttcctccatattactcaagtaaaaagaggtgagaccaaggttataatagagaggagcgtgattgtccgaaaactcaagtgccttgagaaaattagtctgagcgcccttatggtcacccgtattcatctggattagacccttgatattcagggcagatgcattttcaccattaaaaatcagatatcgatctattatttcttttgaagcattatattttccatcagaatataattcaattgcctgaaataataagtcatcctgaagatcatcagttatttctgtgccaatagaaaccccgggaaataggaaagtggagattatgagaagacagacaattcgtcctaactgcatacctagttattattcttcaatattgatagttcgtactgaaaggtatgaaggatacttatgtatgaaaaattaacttgatactggatatggcccagatcacaaaagatgatattattattatgcttgttctagcaggcttctcattttgcatatgttttgggatttcttcaccctctctctatatgaatgatgaatggattactaccaatcaattgaatcaactcttcaccgggaaccagtttattgaaaatgaagggaagtacggaaaactatttacaggagaaatgggcgcatatttcacaacacgggataattatctggcatacagcctaatgcttcccgttatttcaaccccaagtctctttttaatatacactgctggtgattcattcagactacttttccttgttttttggttcttggttgggaccggaacgattctgacctgtgtgcgaattgcttcagactataaaagaaaaaatattgaacggatatttttgatcattctattcgccttttttggattattcttacttaatatttatttttaccagccatttgagagtacatgggcggatagcccgatagaatcagccgcaataatttttacaaacactatcttgttcagtttcattccatctatgatttatataatcttccgatatattcagatgtcacggattgtctctatattcggatcactatcagtgatttgttgctcatcatatcttttctgggctggatcagcaaaggatcatcttctgattgcctttttgatcacttttttagtgtatgtttttactatctatcaggtgaaaagctcctatcttcatgtcttttctctctttgtggtgggaggtctcatttgttgggccagacccgaatatggatctttcattcttgggggtctggtgatttgggaatttgggtcattgtataaacgaaagaaagatacaaaactgaaattattacatctttttcaagagaaggagatatatgcgtgcatatcaggaatttttattggccttgttccattttttctaaataatattcttatcacaaaaaatcctcttatacccccccagtatctctacgttgcaaatagccgaacaaatgttacttccatcattcaggatgtaaattcggaaaatgtcgacgttatttctcagggattttattaccttaatcagatctttacatttttttccccgggaatagaagaaatattagatctatacaggctattctggatttcaccaaatgggagtctaggcatacttttaatatgtccaataataattcctgcacttatttatgggattagagccaagaaaaacaataataaatacttttcgaaagaaaccgtgagtatattgctcttctctttcttcatcatagtattaactgtacttgcatatgcccgggtgattcatggatcaactgtcagtgagggcagtttaccagatatgagatacttttcccctctatacatcccgatggggattatttctgttatccttttatccccgcagatatctttgaatcaacaacgctggctgaattattcattattttcagtatttatcatcagcccgttgttaataattgcatatcaaagcatatttttagatggattttctctttacatacacttttcgctgatgattaaaatattgttaattgtatacctatccattgcagtatgcgcaacaatataccctggattctgggactcaaaaaatattttcccaacattatatgcaatcatgttggggatcccatcatcgatccaattgatgattatcctcatctattcacatgtaaagatgaacggatatcccttttggcaaccggttttgcaatacctcttcacatatgtaatccagattgtgaattaaggtaaaaaaacctctgatttttgagaggttaggctcatcaaaaaaattgacaattacaactcatgaacaaagaataaaatattttttgaaatacggtgttctcaaaatatttcatcactttttaccggttactaaataattaatgattaaatatttttcacagcgataaaccttatcagataatccacctacaatgttagagattaaccataaaattcgtttcccaaatggtaaaacagatatatataaatttattaattgaaagagacataatatcgccccgccattacatataacatgaacgtccgaaaactttgcaaataataattgaaggcctgaatcagtccatctccaataatcagtctttccatgcttactccataccccatgtgtagagagaaaaataaccccatttttttgtaatattctatatccctcacttatcacagaatctggtttttgaacatgttctagaacctgcgttgaaattacaatagtaaatgaatcatctttaaatggaagataagcagcatcacaaataatatcggtaccaggatttttttcaatatcaataccgatgtaaaacttagtaagatgtttgaataacttataatatggttttgtgccacatccgatgtctaaaattacattatcttttttttcaggaggtatttcggatattatcgacatctttagagatttcgctagttctgttaaaaccagatatgatttatcccagatcctgggatttaatattggatccataataatttatttgtcttcttttactttaacaatcattatcagggagtgttgtaatgttgggaataagcggaagaaaattttttgcagataaaatgaatttttaagaattttctgtccaagagtgatttgataatttggtttcgactggcagaaccagtaccgatcaacggtcattccagcttggtaaacaatttttgagagagaatatatggtgaaattatatctgtgatcagtattgacatattctctattaaataatgcataaaaaatattgaatccagataatgcatttggaacgctgattagtaatttatcaacacattgcgaataattttcacaaatcttttttaagaaatcacatggattatcgacatgttccaaaatatctcctagaacaaaataatcccaattttcttcaagaataaatttctcaggagtattggtaatgtccgcacaaaaaacatcatcatatccctttgaattttttaaataatcaatgccatttctatttatgtcaataccaatacacttttggcaccactcgcacaaacgggcatgaagccatgtatggtggcgcatttttaaatcaattagcgggagatgatcacagcatcctatgtggataatctttttattacatacaatctcttcgattaattgaaatttttccttaaatacctcttttcttgagtaaatatgaatagaagtcccattagagaacttttctccacgaagatatgctaaaatcgttgaatcgggtttcattttttcattccatttaattgtgacagataggattgtgaaatattttcccaatcatacattttacttgattttttcgcttcatttcctagtttttcccttaaaacaggatccttcatgagcattaggattgccatcgctatctgatgcgaatttctcgcctgaactaataagccattaaaatttgtctgaataacatccctcactccactgacatcacttgcaataatcggcaaaccagcagccataccttcaagaacaaccacaggcattccttccgtttccccattatccagaactatagagggaacaacaagaacatcagcaattgataacaattcgattttttctttctcggtaatataccccaaaaatgagacgaaattattgagaactaagttatctgccttatccaataaaatttcatgtaaaggcccatttccacaaataagtaagtgtatgtttgcatcatattggatgacctcatagagggattcaattagatattctactccttttttatcagtaagtcggcctatgaatagcagtataaatttattttcaacacaatattttttcctgataggaattatttttttatccagttcaaagcgacttacatgaacccccatcggtagaatggaatattttttacttaaaatttcagaatcttttgaagacaattgattgttaactgcattaaatacataattactcacaataaaaaaatgattggtatttcttattatgaacttcaatagatatttatggaagaataattttctcagtaaaaaaatatccgcggcatgaatcgtgcagatatgtggtttttttagaacgaatgaaataattgcacccacaaaaccttgaggcactatccaatgtgaatggacatagtctatttggttttttaaaactaaaatgaaagtaaaaaatatttcagatagtaataataatggtatctgaattactgataatatgcttgtctgaatattttttgcaatgccagttccatctgcaagtttttgaaatgaaaatggaataaaatagggaaatctatacaccagtatcccctttgcattttcaaaaaattttgctttatagttatgaggacacaatatgacaacatttacacctttttcagatatcgctgctgatagatcaaatacaaaattaccttgaaatttttcgcagtgatctggaagactactgctcaatacaattaaatttttcatatataaaaataaattcgatgagcccttccaactctttggcagtcccataatggttagatttaatcatatctcaattttcattttgaataaagggcgaatgtcaataaataatatatcattatccatttattatatcactttgctcaatacgaaatattagaaatacatcatatacccatctcaataacaattcatgtaagacagctttatgacctgatacctaactaagcaaaaatcagtgttactgagcaagaatacaattccaaccttaaatcgatacctttatatattttcggcgccgccctacggtgagcaccgtcgggcgacctaaagaatatgaagaagccttcttctaagggtcaaaaaaatctaaaatcttgggtatttcagaaatttacctttgattttatagaaaaaaactcgggaaacgggatttatgcagagaaaacggaaactcgatcctgtccttttgatattttccctcatttttggagtcagcagtcatctaaaacccacattagaggagattcatcgtcattatgttgatcttgatgataatccaaagattgaaacctcaattcgtaaccaaagtttcaggaaacggtttaattataaattagtagattttttgaaatccctgatggatcattatatcgatcaaatagttcatcagtcccctgctcatttaaagggaattgttgaggatttcaaagatattttagttcaagacagcagcattattcgaattagtaaaaagctctacgatttgcatcccgcagcacgttcccgtgacgattctgcaggattaaagatccatgcagtttacagtgttgtttaccattctgtaaaaaatgcaataattacaacagaaagagttcatgactataagatgctaaaaattggacctgatgttgaaaatattctcctgattaacgatctgggatactattctctgaaaacattctctaaaattcaagaatatggaggtttttttgctagtagagtaaaaagcaatgccgtttttaaggttgtttcaattaattcaggccctccagaaataacatcaattgtagatcataattgctttaaaagcataaatggtgatgattttttagatagaatgccaaagaaaggtgtttatgatctcatctgttcatttcatattggagacaagcatattaacaaaattaaaactccaatatttcaagaattcagggtaatttgttcttggaatcctctcactgaaaaatggcatctctacatcacaaatctcggaaaagaggttttttctgctgatgatatttatgagttataccgatttcgctgggtgattgaacttattttcaaggaattgaaaggggattacgaccttggaaaaatgttactcaataatgaaccaatggcgtttattcacatttattccatgttgctacggtttattattagcagagatctgtttacctggattgtatctacgactcgaaaaaatgataaaggaaaatatactcagatgctatggtcaaaagtattttcagagaaaggattggagtttttgagcatattgaatcaaaatttatttggcacaggcaatgttaagaaacgatgggataaattagaaagatcactgcggcaccttggcaaaaccgcaacaataacgaaactctcaccttgaaattttcagaaattcaatagggtcttatcttcggataaatgacccgatggagggttaggtactactggctatcggtaaaaaatcaggaaaaactcgtaattcttccttttttctctagtgcctatacgaagcttcaatgtttttagtttagaccgctatagtgacacattagcgcgtacgagtagtagaataaagtgggagaggtatctcgaggtttatgtatgagacatatttgatattacggaaagttgaaaaattatgtcgccgaatctggatctatctccaaagctgtcttacatgaataacaattatatcatttagtatagcatatatcataattggatacttataagtgaaattccccctagttattcggaatatttctagcataactttatctcaattaataattgttttatcaggaataattttaatctcccatcttggaacaacattaggcccgaaaaacttcggaatttatagttcggctatttccatttatggagtctctattgccattgttgatcttggactatctatgtatgggattcgatatatcgcctcaaaaaaagctgccaccttaaatttaataaaaaaaattacccgaattaaaatttttctggcaatattggtaattgcattttcagggattatcttcctatacataaatcccgagagtatttttgtcgcgatttgctggttattttttacatctctcattccttacgcttttaatctcgaatgggtttttaccggtctggaaaaaatggaaatacgggcatttttacgaaccataacatcaataggggtattgttattatgcattttttttattcactttcaaaacgatattatttgggtaccaattatttatttcatcattgcaagcatagttgcaatagtatcattgatattgacacatcttttgagtgaaaaaccattttttgaaacaggagtacttttagaggataaaacccttataatttccagtttccccataggattaacccaaatattgtctctttttttgattaatgcagatcttattgtattagccttttttatttctccggaaaatttgggagaatatgcagctgtatctaggattttatcgacattaatatcaattataggaatgattttcatcccattatttcccgctttctgtagaaaaagtagagattatcgaattgatcacgagaatatacttgagtttgtaattgtttttatttttgccctatcaattcccattatctgttgtgtagaattatttactccttctttaataagcattttatacagttcacactattttaggagtatcatgataatgcaaatattaatatggtatgtaccaattgcaataatgattacaattctgtcatggtttgtattatcaaaaaacgaggacaactcatatctacagtttgtaatatttatgataacccaattggtaattttcatgattatcgggacgaatttgtgtggaataaagggcaccgcattttcggtagtgatttcatatgtaatttcaatttttatcttactagagtgggtcaaaaatcatcttggatctaacttaaagagaatcatacaattcattacagtttttatatgtctcgggttctgttgcacgacgattagtatcaatttagagacttcaatggtatatgtagttataagcgtgatttttatatattcaatttttattttaaaatattccttaataaggttcaacgacattagaacccacattcgccagatcttttttcaacaatagaatttttcgtactccggcccaagcaatcgcaatatcttcaatagttctcgatccaaattctggatagatgaatggagtgcatcattgactgaaataatacatgacttaatctctctgaatttaaaaaaaatccatttgagcgttggacgagaggtaggtttcttcttctgattcaacaccgtttcatcttcttctttcagcctttttcgcagcagcatttcagtatatgagtaaaccatgaggcagagaaccataaccatacataaagcctcgatccttttttcacttttcagataaacttcagcaacccggaatgatttgtcctttaaaaaccggaaacctttttcgacaagcatctgtcctttatagtgattcagaaccgtttcagaatccaaactcaaaacattcgttgcaagaataaatctgcccagatactttttttcactttcaacgaaatcctgagcaagttcaacccttgcatcgatcgaatattgtgggattaacgtttctcctgcttttgggcgccccttcttaccattttcccgtttataactgaccttgatccttgaatccaccaattttctaaaggtgtttcattaagatagcgtaagagagcgttattggcatctgtttcacatgcatagcatactttagaaatctgttttaacccttttaatgcggctttgaacctcacagggaggtttttctgaaacgtcttcaattctcgagctttcatctcttcagatgagacaacaatccatttttgaggaacaccaccataatgtgagtcaacgctactgcaagaataccgtggatctgaggtaggagtgaagagaagatcagatttgagtaactctgtcatctcatttattgtggctgggacatttgatatccaccttgtttccggaccgagggttttgatgtttttatcagtatacagggcactgtcacccatgaagattacatcaggatcaaatgtgaatgaatcttgcaatgataggattgtttgcacaagaacttccttatctgattcgttgccatcgtgtgcacgagcaaaaatcggtatcccgtgttggttaaccaccatacttaaggcaaatctgtttaaatcccagcgtttgtcttttggatgtccctttgtaattttgatacatccatctccggattcatttccatattcaccatgaacactgaaattggttgtatcaacatgacaaagctgtactccatctttgtaaacaataaacatctgggtgacaagatcagtaaagagcttgctggggccatatgcatatatcttatccaaaaggcgaccaatgactgattcatttagattttttgcagaaatatccggacctatgagacgttccaaatcaagatgcttgcagtattcgggaaaaagatagagtcgtctctctgtgaatccaagtccgttgagaatgaggactaataaaatttgagaacttgataggtgatgttgaccgattttagggattgcccggtcaattataggagctaaaccaagcttatggaacgtgcctgcaacgattccaagatgatcaatggtttttatggagtctatttctaatgaaacatcctcatctttcattaattatagtaatggagatcttcttagttatatagtttactattatataaaattgtaatagatctgacgaatatgggttatataacctattgtcaataaatcccaacaccagcaccttcttcatcgcaaagagggccctaaaaatacaataatgcatctttcaggtcgatctaattaaaaaaaagagggggatttccacgacaaataaactggtgaaccaaacctttccagaattattaatctgtaaaagtcaatttctagtacaggcatagtcatgaacatgaaactaaactcagtcatcatttttattttaattctaatttcaatgatcatcacacttatccttcatgcacaaacattttctcttctcacatccggacaatcgcctcaggttctgacaccggatccctggtatattatcaggcagacagaacttgctgctcattcattcccctcctatacttggtttgatcctttcacccatttcccggatggtgcaataattttctggggcccgttcctccccctgctcggtggattactcacccaaatttcaggatcaggaaatgaaaaagcaatgatccttttcgtctcctggataccggtactagctgcaatactgactattccccttacatattgttttggaaaagagatcaaaggagaatggtgtggagttgcggcagcacttcttatagcagttatgcctggaagttacctgattcggtctatgtatggatacgtagaccaccatatcttcgaatcttttttcatgcttgcatattccctcttcctcgtaatttccttcaatcgcctttattctggtgaagggggaccaaaatttaaagtcgcaatccttggaggggggatcaccgggttgatgctcggacttggtatgatcaatgcaccaacaatggttattgcggcaggtatcaccacgtgctttgtaatccttgctggatatcaacttataaagctgacaaaaactctcctgccttttagtatcttaataggtatctcatcatgtatgggagcaataataactctccagttctttacaccagataagaccggagaggttccattcatcttggatccggtttctcttgcatcatttctttttattcccgtattattcggagttttccttctggccattcagatagtcattcaaaagacacatctctcccatcaaaaaatttttgtagctgttttcttgccagtattaaccttagcaattctgcttttcctcctcatccccggttatgcaaccaagatactaaatggagtacaggattttttttcctccaccccgacaaactttgcgattgcagagtaccacccgctcaatttagatgttgctttttttaattaccatgttatgcttttcctgctcatacccgccctaatactcctgctcattaccggaatacgcaaacataatagtaatatagtctatcttcttctttggaccggatttgtcggagttttaactattatcaacatcaggtttgagattctttttgctgtgcctttaacactgacatctgcttatttcctggactggctcttccattttaatgaccaaagaactgaaatttacaatgaagaatcttgccaaaactctacctataagataattaattggaaaaagcgaccagttgcacttatcgctcttgttcttctcattggagctgttggaatatccttatgtatatcaagtataattgcaacagcagattataactatcaaccatacatcgcatcagaagattgggttgagggattactctggatgaaaaatgaaacgcctgatccgggtgtggattactaccaggtataccacgccgattcattcagatacccggattcatcatacggagttctttcctggtgggattatggacactggatcactacgatagcccaccggatggcagtcacaaatccattccaggcaaatctggatatggccgcacaattcttcatgagccggtcagaaaaacctgcagacctaataacctcagaaaattctatcaaatatatcatcaccgatgcagacatgctctttgataccatgcagatgatgatgcgggtttattcacgtgatgcaactcccggacaatatatgggattaatctccataaatgacacagcaaccggaaagccggtaagttcaattggctaccgccagccattctacgaaagcatggtaaccaggctccatgttttcgatggatccagcatgcgaggtgagcggaaaattcttgaacaggaaggaacaccagtcccgggtactgatatgcttgtcatcttcccgggtggtccggatccggaaatttctgaatccataacccgtccgctcaaggatattgaagctcttcagcattatcgtcttatctgggaatccagtacttcattatcaacgactgatgagcatgatatccggaaggtcaagatatttgagcgtgttcctggtgctaccatccagggagaagggacgattgagctgccaatgatcacaaaccgggggagagaattcacgtaccggcagcagagtataaacggatcatttattcttccatactccaccaatcagacagcctggcctgttcatgcaactggaccatatcggataaaagaaactgggaaggtgattgaggtgaacgaggagatgattcaggggccctctttatcgtagattcgaaagggaatcccccaaagatcattgaaaacaaacgtccccagcattcagttcgtcgcctgatcatcgtgggtgagtcggatgatgaactgccagagtatatcagcgctactgatatatccataaaaactcttatatggtatcggtttaggaatgataatggttgcatctaccgcatgctcttcatctaatgaaaaacaaaattttcaaacatacaatttcggcaagtatatataaaagcccaacatggcacccatgatctccattggagcacaaattaaaaccttttagagagaaaatacccgaattgacttcttctcaagcgatagtctgcgtcgctgtagagttaggatatataaactaactttggcactttgactttatacaatcaacgagatcgctcactatcatgatcaaaattttttagattttcatcgagaaatgaaatttgacaggcgggttttttcgactaaaatttctgtagtggccttccatgtgaatgacctaaattagaaaaattgggatagggttagtcaaaagggcatgattgaataatctttctagaataacgattattaagggcatctcctctggaaatattcctagaaatcatttgttgcagtgcatgaatacgccattcaaaatgtttttttatcacccaacttcccatgtcacaatattccgactttcaggatcaaaaacaattccgatctcatatactttccgtccatctgcacgatatttttcagcataccctcgttccctgatctgagcgagtggaccttgatccttacagccctcggatcgttgaactttgaactcaaaaatccagatacctgtacgagtcataactgtcaaattaatacgccctttgttcgtagtatcttcagggatgacctcatacccaaggctggcaaagtaggcatatacgatactggcataatatccctcaaacccggatagtttattcttacgataccagtcatgaggtattgaggcaaaaaaggagtggaaaacatcacgtagccgattgggatcaccggcattcagaattgaatcaaggccgatttgattcatagagatatccgcggatccaccaaggatactgagcattaggcttgaaaatgcgctttttacctcaaggttagggaatcctacagaatagaagagtttctctccaacccgtgattcaccctttatcgttagataccccgtctgaaacaagagagtttctggcaaaattttttctatgagaaacgaccccaggagttcttcacttgccagaaaagaatcaagaactggcagagaacggggattttcagaaagcagtttgataaggaaggaaggtgttccggtctcaaaccaatacgatttaaactctcctttagaaaaaagaagaagtatatcgaacgggttatagactgattcaccgacccacgaataaccattataccatctcctgacatcatcctgattaaacctactcatccatgatctaaaggtcctggagagatccatttcagtgtaaccacaaatcggagaataggatctgtccatggttatatcattgagattattcaatcctgagaatatccccgtcttagcaaattttgaaaccccggtcaggaaaacaaactttagataattatccaaaggcttgatagccccataaaaatccttcagtatatcacgcattcgagtggaaagagccggatctcccagattatccaggatgggcttgtcatactcatcaattaggataacaacctggttgtctaatctctcgacaatcattgagatgagggaaataagtcgttctccaggagatccttcagtcttatgtagatcaaatctggcttcccatcgtgtaaggagccgatcgaaccattgctcgagatctatcgtggatcgaagagctgacccggaaaaatcaacccgcaatatcggatacagcgtttcaaaatcccaacatacctccggttgagaaagatagagtccatgaaataattcttttttcccggagaaagcgcagtcaagcgtatctacaaacaggcttttaccaaaccgacgaggacgggaaagaaagtaatacttcccagagtcaacaagagacgcaacaaaggctgtcttatctacataggcataacctcgtgtcctgatttcagtaaaagactggattccaatgggcagtttatctgaactcataccaagaataagttacatatatgatctaatcatttcttttttcccgcgtgttagaggagagaacctcctgcatgtacctgaaaacttatacaatatctcatgtcctcaaaagcagaaaaccattactccttataaaaaacctatggacatgtgaaatacacatctcctgaaagatagaggtcgaaaattcaggagaagtttaaggggtgtaaaaaggggaacaaaccatatttgaaactataggaaaatcaactacggaacggcccgtgatgaatgtaaaattcaatataatgacagcatagatgaccgacaaacaatgctgataatatccataagaaaacttcttatttacatttgactgaagttccggatcgatatgaaaggggatttggcattcatatcagatctgcaaaataatactccgttttcttcagataaatcgctcccacaataaaaaccataatactgatcccaaaagccacgaataatcctgcccagtcaaaaaccacatgaccaagcgtacaagcacggtctgcatcaagaaatccggtcatgggattcatatataagagccattgaaggtgctcctgaataatactgaccgggtagatgactggtgatgcaaacatggcgagttgaatgaagaacggcagggcaaactgtacatcccggtactttacatagactgaagagagaaaacatccaagtcctgttgcaaacagcatcgtgcccagaatgataactggcaatatcggtattaaaagggtgggaatgaaaccataccaccccattagtaagaaaagaacaattaaagcgatgaaataatccaatagtccggaaatttaggtgctgcatggaaaaatatacgtggaaaatagaccttggaaagcatgtgagcgttactcacaaggcttattaacgcatcagaaagtactccactaaaaaatatccatagaatgagtcctgaataggagaaaagcgaatatggaattccattcgagggcattctggcaagtcttccaaaaagcaacgaaaaaaatatcatcggaaagagaggttgtaaaatcgcccagctggcgcccataattgtctgtttataacgaatttttacctctctcgatgttatgtagaataattcttgataagcccagagtccggaaagttccaatttattcctctaccaggtggacgaatgatccgatggtgacgagatgatgtttccattattatcccaattgcggaaaatgaatatataaattattaaccaaatcctatatgtattcgattgatcaaaaatcccaagtcatgagtatatgaatcattcaccaatgtctaatttatatgaatcatacgaaatcacatgaacgattatttcgatgctgacattttttgcaatatttcttccatcttaattcattgaatagcatcaccgggtaaaaaaagcgaaaatcgatcgcattcaggtaaaataaagcaacagccgtataaataatactcaaaatgcaaattaatagattattaataagaaaatttgaccatataagtaaaagaatttggctagtgaggtcttttttatttttactattttatatttataatatctatggatccgctattctgcgcctccataaaaaaaccaaacagacaaaaatacaccccactgcccaaatacatccatcagcatgcatatctccttggggagttgtaattgacaaaaatgtgaaaatcgggaaaaaaaccgttataaaacctcataccaccataaattccggagttattatccaagaccagtgtgtaattggtgactcaggctatcaaatctatcgatacaaaacaaaacgattgccaattattcatacgggaagagttttaatttctgatgatgtatatatcggacccaatacttgcattgacagaggcctgtttggaaaaaatacatatattggccctcgatcaaagataggagaacatgttcatattggacataacatttggatcggaccagacagtattataggaaataaagtcactatcgggggtaacactctcatcggtgaaaaagtgcacattggaaataattccgtgatatccaaccgaatcaatatctcttctcactctgttctgaaaccggaaactattgcaacacgcggtatatcaggataatcaattatgaagatttcagattttgccgaattagagaataaaataaccaatgatgcgaacttttcaactattggtcatctacatggaaaaggagaaaaaaggcttgttccaattaattcagagcaggattttcaatatgccgtactgtcagaaaccattgcaggtttcataattccaatgactattcttctcccaattgatacagaaaaaggcttattaatctccccaaatcctctgaaaacagcactatttattcaaaaagagatttaccagaaatccggagaaagcaaaaaaccgactaaaatacatccctctgcaagcatacaccctactgcaatcatctctgaaaacgatgtaagtatcggtaaaaaagtacagatatatgaacatgtaattattcatgaaggttcaataattgaagataactccattatcggaccaaatactctaatcggttcaatccctcaatcagatgattcagatcaatcattaaaagaatatcatctatttggatcggtccatatcaaacaggatgttgttatccacgcaaattgttgtatagagaaaccatggtttcaggatacaactatcataggtaaaagatgccatatcgacaatctggtcactatcagacagggagccgttgtcaatgattgttcccttatcacagcaaattctgagatcggagagtatgtaactatcggaaaaaactgctggatagggcttcgagccaccatccaccctggagtgaacattggagactcctgttatgttacattaggatccagggtcacgaaaaatattggtcctggaatggtggtaaaggataattggacaataaaacgtgaacgatttaaagggataattacctgatacaactcagtacctttttccctgcatttacgacagtatccactccccctaaatatatccattccccggatgaacctgcccatcgttccggatgagtcagaatatacacaatatggggtttattatcatcaatagcccggataagatcccatgtcgaatgcacatcttcagatgaactatttatctggttctgcaatctatcccgtattttatgagtattactccaggttcggccggtatctgaataataatacacacaatttatcgacaggtaggcttcacctaaaaggtcaaattcttcaaaggaataatgattccagaaatcacggttatcatattttgataatggagcaccatgcatacaaacagttttaactggaaaatattttctaaagtcatttaattcctgttgaaataacttacccgccagatcaggatcgccatcagctttacttattacttcataatgataaccgatttcatgacccatatctctgactttttgaatgactggaggctgaaaagtatacggatgccggaaataatacgttgcacggatacctaaatcacgttcaatatgtgcaaaatcaactgctttgtaaatccggcggtcaatatcatgtctcatgattaccgtattccgggcatcattgctcccggaaagataatcatcaactgaacatatcgtatatccggaggttaaaaaaaaccgtaccaactccctatacatttcaagggtaaaatctttcatattattgtcaacttaaaaataatcagatcacctgaccgccatcaaccccaagaatctggccattcacatatgagccaagatctgatgcaaggaagactacggcttttgcaatatcatccgcctgcccgattcttcctaaagggatatgagataataaatcctggcgggtttcatccttcacatcatgagttagatcagtatcgataaaaccaggagcaatagcattaacagtgattccgaaaggccctagttcttttgcgagtgatttagtaaaagcaatcaaaaatgattttgtggctgaataaaccgactgacccttactgccataaaccccgaccacagaagaaatattaataatacgtcctgatttatgtttaagcataagttttgcagcagcacgggaatagagaaacggtcctttacagtttgttgcaagtaataaatcaaactcttctgtttttgtcataagaagtaggttatttttcattatccctgcattattcacaagaatgtcaagtcttccatattccccttttattttatttattacctttttaacatcatcttcattccggacatcagcctgaattgccatagccgaaccgtttttatgatgaatctcgtttaccacattctttgctgactcttcatgtgattcccaagttattacaacttttgcaccttcgtcagcacagcgaagagcgatggccttaccaataccccggctaccacctgttactaataataccttattctcaagtaaacccgtcattttttcaccaccgcaatccaccggaccatccttccggctccaagcatcccatcccatggctgagtaaattcatgcatcgcccctggagccatcacccggtccactccccggtaagcaagttcccggacatatctctctttcctgacttgatcaaccatccccaaagcaaccgtctgaaccttccgggttacaaggggaagaacctgatcaatatcggatacttccttcacaaaaacacaccttccctgaaccggttcctcaagagagatggtatcatttatacagacagtccatttcaaatcatcagataaaagaatatccttggaactatcaagcagatatcgggcacgggtattaataaccgagatggcgatcccctcatccaggggataaaacattctttcaggaagagtttgaaaagccgattttaactgctctgcaatgtcatgaagtaacattttactcttttcgaaaaatatcgtatgaggcgaagaacaggctgcctggttataaagaacaatatcctgagcaagtcccttcagcatcgaagagaattcaggtgactcaaccgcttccttatcaaaaaccgcaaaagaatatttgggaccatatactattgtatcagcatggacctgatgtgggagacaggatatcgcctgcactgcctcatgactgccatagattaccctgcagtctgcagacaatgaaaagtcccggctcatgatctcattttttccaggaaaggaaaccagcgagactgataaggttatgactttcccgctatatgatactctatcaatttcaatggtaacctcctcaagtttctgtaataacgggttgagatatttatagactgatggatgaattttcaaaatactggcattttttccaagagttgctaaaaccagagagaaaaaaccaagaagcggaatgtttcctgcaatccaatgacagacgactccccggggaacatgaatcatctcacttcgggaatctacctggatagaatcccttatgcccggttttatcccaaaatttgccagatagattgcatggaggttttccttccgaagccacagggaaaggtaagaaagaccaggaatatatgccagagaagaatctttaataatctcctttccaaagtgtgcaaacaggtgaatgatgatctcatccggacactcaaacagggcacgacgattctcctccagttcctgtatcaattcggtgaatgattcaacatatcgttctttgtctacacaaccccctgcataaatatgaatattatcttccatgatccacccggaaggtatccccgcatccccgtatttctgcacgttcgacccggtttaaaaattcaaaaaacacaccccttcttccacaggggcatccatcccacccgataattctcccggtatcttcagtcaaaagagcctgcccataataactattgggaagaatactcattacttctataagtccgcgctctccttccccacaaggctttaatgtctgaatattccggataatgatcttcgcacaggctgggacgtgcttatatccgcactcacaatcaggaaagatgatcccggtctgttctgccatcccatagaaatccaaaacccggtatgaaggtattccaaaaaaatcacgtatattcatggtaaaaaaatccttcccgacagcaatattctgaaggtttttccatcctccgccatgaaacagggtccctccggaaagatgaagatggatatcatgtttcttgaaatacggtatgcacaccgaccagataatccaggtaaaaccaaacagataaaccggtataccccgatcgagctgcctgatttcttcaagagcctcggggttaacagtaagataatccccttcttttttcaaaagataaattgtcttcctcgcatagagagacaaaccccttactccggcagtcctggctgaaaattcatgtgcaggatcatttatctccggatgatctatcacgataaaaatcagacgcttcgggccgagatagtgtgctagaattttcgagagagatctgttctgattctgaatggtaattttatctaagggaattttactcgtctgctgaccggttgttccggatgaacgaagaatctttacaatatcatcagctggcaccgttgcgaggtcgaactccttgaacatggttaccggcacccaggggacatcggcaagagaagagatatcttccgggttcattgaaactttttcataatatgaacgtatatgtggattgatgagagcattcctgatctgctctttgataatgggaaggagtatgttctctcgctcaatttcagtaagatcatacaccccatacttccatatcagggagatcagatgatcattcggatttacagtcatatgaagagtaaagtcttttaatggcgtccctatcaggctttccagatgaattcaaaggaagattttgaaggactaatatatctgtcggttgtttatgggagggaagatgaccagcacagtgtttttttacctcagatattagggattcactatcataatccgattgaatacaggcaactattgcttctcccagaatcggatgaggaataccaaacaccacacatacacctacatattcaacctgcattattacgtcttcaatctcctgcggtgatacccgaaaacctgcagatttaataaaagtacctttccttccgattatataaataaacccttcttcatcaacagtcgcaagatctccggtataataccacccatctttgataaccttggcagtctcatccggatcctccagatacccggccatgatattatccccggctgcgacaatctcacctacttcaccgggtttgacttttttgccatccttaccacggacctcaagagtaaccccgggaatccctttcccgatagaatcaggttttttaaacaggaactcaggaggaagatatgataatcgggccgttgcctccgttgctccatacatcacaaaaaattttttatcagcaaaggttctggcaatttcatgaatcactgaacaggcgagatgtcctccggcctgggttaaatatcgaaggcttggaaacctcattgtgagaaaaggggttttttgaaccaggattaaaaaggtactcggaacaccagcaaatccggtacattgaaactcatgtattccttttaacgctcctcccagaaatggagactgattaagaacgagactacccccaacccgtatgtgagtatgaagaagtgacgcaccataacaataaaagaaaggtagaacaaccatcatccggtcatctgaagagagattcaggtattgaagaattgaattggtgtttgcaatgagatttttatgagtcaacattaccccttttttgaccccggtacttcctgaggtaaaaatgattactgcacattcatcctttggaatatgggaatgaaaagacatatcactatgagtgatatcgacgggttgagaagagagtacctttactccggccagcaatgattcatatttctgatccgcgaaaacaatctgaatagaacatcgggtaattatctgttcgatatcttttggagaactctttgtatcaattacgacagcagtatttcctgaatgaattattcctgcatatgcctggataaaaaaagtagagttatctgcaaggattccaatccgactattcgttccaatggaattctgtatccatacagatattcggagtatagaacaccagatgtcacgatatgaacaagacttgtccccggataaaataagagatttatctgaatcctttgtatgttcaaataagaaatcgataaaattcattttttatgtaagatattttaatacaatttcacggactttcttataagaactcatatcaataatgtcatccatctcaaactcaatacccagttcttcttccaacatggacactaattgaaggtgtttgagagaatcccatggttgataggaattataagcaatgtcatcatgtacttcttcttcaggaatttcaaatgcttgagcaaatatttttttaattttttcttcatgcatcacatatcacaccaatacacaaccaatgcattactgactgctgcctgagcagtatgtgagatacttatctttatctcaacccggtctaaaaaatctgttgaaaactgtttacctataatgatcgccttcggaccttttttatccacatgcaatatctcaatatctgtaaaagagatgaccgtttgatcaagtgatgaaaaagctttgattatcgcttctttagcacaaaaacgcccacataaactctgtgcaggatctattttagaaaaacaataatccagttcattctgtgtgaaaattcgtcttaataagttactatgtgattcgagagaaattttttcaaacctttcaatcaattccatatcaataccaatagaaaattttggtattctgaaattattgttgagcatgttccatatccacttgaagaagaattattttctcaataccacacccctttattctcctcctgcatatcaaacatcattgcggaaagtaaaaactgcaccccaatcccaaacactatcaccgaaacaaccgccggaacaaatatcgaattattcattataaacttaaaccatagtgcatacaaaccaaacaaaaacgaaataaacgtaaaaaatacacctgcacaataaaaaaacacgagtggatgaaatgataatacaatatatttcgtcttcatccgccagataaacgcattcaataataaccaggataaacggacaatatacgttgaatactttatttttgatcgttctaaaccataccttgcaggatgaggaacatttcggaccctgaatccaaacgtattcagccagaccagaagatcattacagtatccgtaaccaggatagatttcatctaatgaaattgtctccagagcacgacgcgaaatcgccgtgtacccattttggggatccattaattgccagtatccagacgcaattttcgtcagtaatgtcaaaacagagttcccgacaaaccgccactttgacattccctgcctgaacttctcatttactaaccggttcccaaccgagtaatccacaacaccctcaaccactggatccaggagttcaggaaggaaagttggatccatctgattgtccccagccatcaccgcaacaatatccatcccatcagaaagggcttctttatatccggagatgattgcaccccctacccctttgtttttttgatgatggatggggaccacccggctgtccctctccgcatatgaatcgatgagagatccggtccgatctggtgatgcatcattcacagcatacacccggtcaacgaaatccggaacagactccagagtaggcacaataagcaattcctctttgtatgcaggaataacaacaccgatttttttatttcgatacatcagacctcataggtatcaatttttgatggattatccatgattgtattgattgaataaaatttgtatatacaaatatgaacgcccaaagagatttacttctttaatattataaatatctgtcaaaatactggaaccgccgaataaaagccccatgagctcctttcacctatcaaattaagaaaggtattcaccacgatatactatacattttacacagataccccagagggaggaacaatatgaaacgggtaaaaattatctccaaaggttacgttcagggtgtaggatatcgggagcatgtccgaaatgctaccttcaggaagaacatatcaggttatgttcaatatcttgagtcagacgacgttgaaataatcgcagagggacaagagagtgatcttagaaactttattaaggagatcaatgtgagtgaatacccgattgatgtccaagatatgaacgtcacctggcaggaaccaacaggagatttaaaaaagttcgaaataatccgtggtgataaagaccaggagttatttgaattaatagatgtggctgtaacacgcctctgccgagtatttgaaaatacatcaatgaaccaggaaaagtaggatcagatgtttagaaaacgggatgagacgatccctttcctgatagtttccataatcactccacctcatgtatccggacacatcgatccccggtaaacaccaatacccatttcttcaggttcttaagccccgcaagttcagggggtgctgaatactttttgagctgcatgattccatcattcaaaacctcctgaaccctctcctcacatgcatctttcattttcaggtacttgagctcgaaaaaggcattgtaatcaggattccagggctcccgtgccaacagagcaatgtcgatatatccatccggcacctcatattctgacttgaccaggtagaggttactcatttgagcgaaggtaaaaataatgatcttgatatatttctcatcaaatccgatataatcccggtttgaaaatgaatgaagcagttcttctacgaggacaaccagtttgtcacaccttccctcccatgcgatctcttcgattgcatgcaatattgacccggtatccgggtggtactctgcttttcgtgagatgacatccaggaaaaaatctgaatatatcccccggataacaaaattcgggatctgaagacttaccctccccggcatattatccctgattgtcagaaaccctaggtagaaaaggagggatttaaagtcatccggagtaaaccttctctccatggagaactgatcggtcagccgtgcagtaacacacccggcatcaagaatctcctgcaatacagcaatattttgttcaggggatttcagtctcataagccggtctatcttaccataatcactggcaatattcatatccagtagtttttccgggggtttgtgccgtgcaagataacttttgatataatagaggatcatatcactgttaaaaagccggacatctgcatcttccgagaacaggtacccattataatactcacgcagcgttctgaccaggtcaggagtatacatatcagcaggtaagatctgtccgatgaggctcctgatttcctgttcagtaaaccccatcatctcatggaagaccggatttctggtaaggtcatctgcaatattaaacccggatgtaagactatcaagggttaccggagaaaccccggttgcaaaaattcttcctacaaattcttgtgtcccgatcttaagagcttcataccatttccttataaagccctgcctgcttaaggtatcctgaaagagatccagatcaaaactgagaagttcatttgcaaaatgatcatactcatcaatgaggacaaaaacccgccccctcatttctgaaggtaatcgtgaaaaaaaatcggcaagcatatctgccggataaccggagaagtccggtatgaaatcaagatgatacagttcaataaatcgaaccagagactgctttgtcctggcagagatactggcaaagagggaatcctcagagctggtcgttaacgcagaaaagttaaaacttaagatatagtaggagttatgtttcgatgttgggttttttccgatatcggtccctgagaagagcgaagaaaaactatcgcattgattgatatcatagtagttttctaacaaagagacaaagaggctttttccaaaccgtctggggcgaaggaaaaatacatatggagcaggattctcctcaagaagacggataaaaggagttttatctacatatacatatccctcttctatgatagtcctgaaattactgataccataggggatccttttttgcaccattggatacagagggtatgatcatataacagtataggttcaccgctcgtgtcaggaatgctgaactataattccgactattttcttttgggcaatctcactttttaataatcggtttgtcgggaaagaaagaccaaatgattcaagaatatccaataacctctcatctaccatgtatttatgcaaagatactctataattatgcaagatggatctcattcgctccagatatatcattcatggagatgtccagcgtgtcggatatcgtgatgttgttcagaaactggctataaaaaatggtattaaaggagaagtaaggaatctcgaagatcttgacgttcagatcattgcagaaggaacaaaagaagcaatatcccacttttcgaatataatatatatacaggattttccaatcaacgtcgaatcgattgaaacacgggaagaaccatacaccggggagtttcgaacgttcaagataatcaggggtgacacgggtgaagagatggctgaacggatggataccgcaatccaacaccttaatcttattggtaaatacagtaagaccgcagctgataattcaacaacattgatagagatgatgcatacctctctggataaacaggatcggatgcttgaaaaacaggaccagatgttgcaaaaacaagaccagatgcttgaaaaacaagaccaaatgattgggaaacaggatgacatgatctctgtccagcatgaaaccgtcgatgagatcaaaggccttcgaaaagactccaaatcgtatcttgagaaagaattttcagagatccacaaaaggcttcattctatagaaaacgcccttaatgacgccggaataaaaatccattgagctctagaaatcatctcccaaaaacctcaccgccccgtctcccatgaaacaatatttctcgtttcaggatcaaaaaccaccccgacttcaacaaccggccgcccatcagcccggtacttttctgcataccttttctcctgaatctgtgcaagaggactctttcccttgtttccatcagatgactgaaccttaaattcaaaaacccagatggaattctttgttatgacggtaagatcaattctgccacggtttgttgtgtcctctgcaataacctggtacccgagacttgcaaagtaggcatatacaacacttgcatagtacccctcaaaaccggataactggttttttcgataccactcatgaggtatggaggcaaagaatgagtaaaatacttcccgaaggttatccgcatcaccagtgctcatgacacgatccagatttctctgtataatactggtcccggagtttttcgtaagcacctccagcatgagagaggagaaggcacttttcacttccaggtttggaaatcctaagcgatagaatgccttttctccaatatgggtaacatcttttatcgtcaggtaccctgcctgaaaaagcagtgtttcaggttttatgtcatctatctggaatgaaccaaggagctcttctccggtaatcagcgtgtcaagatcaggaagggaacggggggtttcagcaagtatttttacaagaaatcccggggttcccgtttcaaaccaatatggacgaattgttccctcgtccaggaagagaagaatatcaaacggattgtataccgactcacccgcccatgaatagccattataccagctggcaacaagatccgaatcatacgctgccatcagggaaccaaacatctcccggacatcagactcagtatacccacagatggatgagtaccgccggtcaagggtgatatctttcagattattcagacctgaaaagatacctgtcttactgaactttgagactccggtcagaaaaacaaaccgaaggtgtacatccagcggttttatagcaccataaaaatcccggagcaggtcccggagctcaagagaaagatcaggtttttccagattatccaggatcggcttgtcatactcatcaacaaggatgaccacgtgttttccagtcacttcggcaatccggggaacaagatataccagtcgttctccaggcgatccctctgttctttttacgttgaactcttcttcccacagatcaataatccggtgtaatctgccggtcaggtcatctgcagatctgatcgtgcccccggagaaatcaatccgcagaactggtgaggcccttgtaaagtcccatatcgaatccggctttgtcagtgcaagaccctcaaacaggtaagccttccctgaaaaggcacaatcaagcgtatcgacaaacaggctttttccaaaccggcgtggccttgaaagaaagtaatatgaccccctctgaaccagatcaaggatgaacggggttttatccacatatacatacccctcacgacggattttttcaaaggactggataccgatagggaggagagttctggccatgtatgtataaggataggatgtatagtgctttcacctttccttttgccagatttataacaataaatttaataggaaacaaacatacactaacccattcatgcccgtttcagtcctgtatgtagatgatgaacttccgcatctgatgcttgcccaggagtatcttggtgcctctggaaaagtcaccttaacctgcgtttcttcaggaaaagaggcaatagatgcgttgcgaaccgggaagttcgatgttatcgtatctgactatctgatgcaggatatggacgggatacaactcctcaagtatgtacgggctaactatgagagtaccccgtttatcctctttaccggcaaaggaaaggaagatatcgtcatttctgccctgaacagcggcgcagattactacatcagaaaaggaagtgatccggttgttcagttcagtgaacttgaacagcggatcctgcaggcatatgaaggacatcatgtaaaagaagaacttgctgcccgtgaacaactttatcactccgtcctgaccgttcagactgaactctttgttgacatcctccctgaccttaccatcatcagagcaaatgactcctacggtgccctctatgccatgcctgcgaccgatctcatcggaaaaaagtttttccatgacatatctgatgaagaccgggcaggacttgttgaaacggtccggtccctgacaccagaaaacccgtcaaccgatcttgagacggtagtcacctatccggacggaaaaaagagcgagatcctctggcatattgaaggtgtattcagctctgacggaatggtcgtcagtgccaaggcaaccgggcgggacaccagccaggcagagatggcacgtgaggtcctgcagcagtctgaacagaaataccagcagaccatgaccgatgtcccccagcatatcggtgactttgatgagaatgttccattgaactttatcatcgaaaacacacatcccctgggtaactggctgcttccagaactggtcagggagatgaaagcccaaaaagcctatggtatcgcagcgacagcaggggcggaaggttttcgggcatttctcatctttatgaagggggaaccggaagggggcatatatattgaccggtccggggttctgtatggtgaccggagtgtcctgttcctgaaaaacagccagaacttcaccttctatccgactgaacctgagatcgcgaacaggtttgtaaccggctgccgcatctatgataaaagtcatctccgggtcccggcatcaaaccccatccccgagatctcctcagtcagaaaagggattggaaatatcatcatcaacctggtaagaggcggaatgcctgtagccggtctgcgggttacaatcaagagcggaggcaagattgtcggcaatgatgtcacctctcagcagggccagactacattccagttactctacggccagtataccggggtaatccacaacgaaactggtattctccggtccttctcttttacggttgataaacctgaactcatccacacagtcgatctctcctgaaccaatactgagctcagaacttttttcccttaccgggtgggattatcctatgagatagtctggttttaaaaaaccggcatcgtgagatatgaactgaacgatcacaaggtatcaggtcagttcccgggacaattccactcacccatatctgcaccttacgaagtcacgtgggattctcagggaggttatcatgcggctctacccaaagatgattctaatcattgcatgcacgttctttgcagtcatgttcgtgcttctgttctcgtttgagttgaccatcatggactcattctcctcccttgaggagaagtacgtggaacgggatctgatacgggctgaacatgccattgatgaagaaataaaaaggctgcagcagattgcaacagactggggagaatgggataccacctatgactttgcccagagccgtgatccgaaatatatctcatcgaaccttgctttatcaacatttgaggcattacagataacctccttaattattcaggacctgaacggatcggttattgtcgggagaggagtaggagaaaggaaggatcatctgaccggtgttcccaccgagcttgtgaaggcggttatgcagatcagcagcactccgcaggagaagcactcaggtattcttgaatggaataattcagcatgggtatttgctcagaaccccatacttaccacgcatcagggagggccatccagggggaccatcacagtattaaaccctcttgaccaggacaaactctctgatatatctgatcaactgcttcagaatgtgacggccaggatcctcacccccgaagagaggagccagggatacccggacctgagcggatctcagataactggtgacacgattctgtcgaacaggattctttcagatgttcatggttctccgtttttactcctccaggtacagagtgtccgtgacctgtatgagagcgggttgttgacacgggactatctcttcttctcactcctgcttctggtggtatgtttcatgggggttgccatcaccctcatcaacctgattgtaatagcacccctttcagaactgaatgccgaacttgcacagatcggaaaaaccggactcttgtcaggtcgtcttaaaaccggacgggacgatgagatcggtgacctgagcagatccataaatcagatgcttgaccagattgagcaggcggtagagcagcgacatgcaaccgaacagcgcctctcacggcttatcgcccttgccgaagaaggaatctgtcttgtcgggccggatttccggatctggtttgcaaatccaaaacttgcatccatctttggcaggacgccaggtgaactgaacgggatggagatcacggatcttctcgaaggtgaacccataccggtgaatgaactccttagtaatcaatcggttcacatcgaactgcacaccagaaagaaggatggctctgagctctacgtcagggtggtttcagcaccctatcccctcgacaccggacaggaagggcacctgtgtgtgatcagcgatataaccaccttcaaggacaatgaaaaggcactcctcctttctaataagaaactcagcctgctcgggagtatgaccaggcatgatatcgtcaaccagctcaccactatcagagggatgctgggtctggtccatcggaagacaaccgatgaagtcatcttaaacctggtagaagctgcagaggaggctgctgaccgggtcaacaaacatatcgagttctccaaggagtaccagaaggccgggatgcaggcacccatctggcagaaccttcggacctgctggagtcttgcctatgcaatgacaaagaaaaagggccttaccttcacgtatgaagggggagactatgagatatttgccgaccagttgttgcagaaagtattctacaacctcatcgataacagcctcaagcatgggaagaatgtcttttatatcacgattcatacccgcctgcaggataaggatctcatcatcagttacgaggatgatggtgaagggattccggagaatatgaaagaacgggtatttgaacggggagttggatcaggtactggatggggcctcttttttgtccgggaggtcctttcgctgaccgggattaccatcaccgaacagggaacattcgggatcggggcacggtttctgataacagttccggagggaggataccggccggtggaggtgctgcaggtagaagaggactgatcctctgtacctgccgggatctgatcctctataccatgaaccggaaggttgcccaggcgatgataagcataaggacagagtatttcagaccggcagtcacccggccctctcccataactcctgccacaagccctgagaagaacccctggaacatgccggcatgggagaatacccggatatagagggcgagatcaaaacctccgagattaaacccggcctgaccggataccccgctttctgctccgagatctgccatggtctttaagaacgaagagacgaggatcataacgacgaagaggaacacggcaaaagaggcaaggatgatgataacatagatgaacatgttgttcttccggtcagtcttcatgaccacgtactctgccgagtcctttccggccgcacgaagaacctcaacgatgtcaccaccggcatcactggcccgcgcaacaagatccacactccgctccacaagagggatggggatctcttttcccagctggcggatggcatcgatgaatgcaaagttccaggatatccgctggtcaagctgacggatgtggggagtcagagcaccgtactctgcctgtgagaccaggtgaattgctccgggaagggtcatcccgctctcatgcatcccggcaaggtccctgaagaagttcggaagcgcaacctcaatactggatatccgtcgtccctccagaaggtcggttatcgcgagcggtccgacgatgatgatagtggtaaagactgcaatatcatcaatgaaggaattggtaagtatcgcctcaggaccgccttgctgaatgaccatagaaagcccgatgataaagaccaaaagccctgccgggacagatacatagaggatattaatcggcttttcaaacagggtcctgaaggggtgcttgacaaaccggagtgcaccttcagagtagtggtgataggtatctatctttttatagatctcatcactcttcggatctgtcgaaggttctactttcttcttctcaaatagccccatcctcaccactccggagtcattgaatcgatcagcaccacaaacataacactcccgaaggggatgatgaggtagatgatgatgtacagaaacaggggagttgattcgcctgagaggatcgccataatcgactggataaggatcataaagagcgttcctgccacaagcgccgtgacataactctctgcaatcagtgccagagtgtcaaggaactgcttttgtgtctgcctgttctcaccggtatactgctcagcttttgtcctgaaatagtcggagatattactccccgccgcaacacttccgatacacccctgcaaaaagtcgcgcatacgggggctcggggtgctcatcgagacgttcttgagtgcttcaatcagatcccggccaaagacatccacctcaaggatgatgtatctggcctcaaccgaggactcgccataaatggtagagttgcctagctgcctgaagacctctgccggtgtgatacctgccgtcgacatggctgcaagataattgatcgcataggggagggttgtctcaatatcacgccgcctccccccggcgacgatggaggggtagaccaggtaaatgagaaacgtgatcccgtacaggactacgaacgagacgattccggcgatgatggttccaagcagaagataatgcccctggaactcattgatggttgctgcaatgtctgtcgggatgttaccgcgaaaggtgatgagtccggggacatcaaggagaaagaccaggagcgcaatcagaaatgaaccgatgataccaacaaggactgaggtaaagatagcggttgcaaggtaggcttcaaaggtgatccccatgcgtgcagatttgagattctcaataagctcatagtacttctcacgcctccctgacatccggctcccgagaagggagaagcagaaccgctcatatgaattcattgccaccagaccgtatctgctccatcagggtttcggcatccctgaagtacgagacgacaatcttgctcacatcacggaagtcacggatcttcttctcacgcatccattcaaggacctcctgtcgctggagcaggtcacgcctgatccgttcctcatcccacccgtgtgcctccataatctcttcaagaatgaatgactttcctgagtaggagatctcatcggttgcctgccgccacctgaacacctcattcgtgatcagttcatttgtcctgggatcgatgtcaagaacctcgatgatctgtttgttcctcctgatgcgctgaccacctacccgtgcctgtatctgaacacacaccaggttcagcgctgaaagcatgttcctgggcacagagatgggcgggttttcaagacgatggactgctgaggataccgaatccgcgtgcatggtcgagtaagtgacgtggccggttgacatcgcctgaaagagggtgagcgcttcacggccacggacctcacccacaatcagatactccggacgctgacgaagcgcagccttcaggagctcatacatatcaatctcccctttcccactcacatcaaaggactcacgagtgacactcgggatccagttggaatgaggcagtttcagttcacgagtatcttctagggtgacgatctttgcaagcggcgggataaagagggatattgcgttcaatgaggtggtctttcctgatgccgtccccccggcaaagatacatgactttccgttctcgaccgcaagccagagaaatgcaatagagagaggtgagaatgtaccccactcaatcaggtcggtcggggtgatgggttcatccttgaacttacgtatggtaaaggtagagccatgagcagtcacctcagagccgagtgtcatctggatacgggagccatcctgcatagtggcatcgagcatgggatctgcaactgatatgtgctttcctgccctctgggccagtttggttacaaatgaatcaagttcagcagcatcggtgtaaaaaaggtttgattctatagattcatatctggagtgataaacaaaaagcggccttcccacaccgtcacaggagatatcttcgatataccggtcatgcatcaccggatcgacaagaccgtcaccaagaaaatcctttttcagatggtagtggatcttctcataggtcaggggatccagagagatggcataatcggcaagaacctcattcatcatagactcaagggtctctgccgcagtctccctggagatctgccgggtgttcacattcacccgctcaaagatcccttttttaatctcgtcaaggagttttttttctgcatcggtatagatgggctcaacaacctcgtagaggtattcgtgcgtgatataattgtaggtgatacggatgtatgcaaatgggggattgaccggatatacctcaatctcctcggtccccggcggcggttcaaaggtgaggttgaccatcatcccatgaaccttgggatcatactgctcacgcttctttgcaagtggagctatcttactaaatgaactgaacagggacttctttttcggttcagaggaaacggattcaggaacttgcggcacttgtacatcctttttcccaagacgacgaagcccggacggtttttcagcagcctctttcttttttccaccgagcgcggataatttcaagggttttgtcggaggggcaggttttgccgcagctggatctccagctcccgtatccttccccttgacaccatttttctctttttttaaactccccaccctgactttcatgatgaacccggctgatcaggacaaacaacagtataagaccccacctctgctctgaccctgaccaaaagagacaccccctcttcttctactaccataattacataagccgcaataaatagataatggcgtaactatccatggcagtgtgcatggattctccatattgacagaccatcatgacagaagagtctgatgacaaggccggatcaatggtccggacctatgtcggaagaaatagaacaggtattaacggatttgatctggctcttgacgggggatttctcccagggagcacaatcctgctaatcggttcagctacttcagggatcgatcagtttgcccgccagttctgggagatacttcctgagcaccggagatttttcatgctggacgggtaccttcttgacgggatggtccatgcacgggggctatctacagcagaaatttttgcccatgccggagacggcggactcattattgactccctgtcaaccctcatcatgcgtgaggggatagatcccgtccttgccggagtggtctcatgcagggctaccattcaggcatcacgggacaatgctctcttcaccctgtacgaaggcctccatgccccatacaatgagatattactcatcagactctgtgatgttgttattcacctgcatgaagatatgcatgggaacgagatcatcagaacacttgatgtaaaaaaactgaccggactgcagcctccgggaagactgctcccgtttatcatcaccggaaagggtatcgagctctcaaccacatcacgggtggtataaatcacatccagtcaagaaatcttttcagacggcccgtttttttctcctcatcatcctttggtgagtgaccgaaccggctgttaatatcggcaaagtctatgtaatcaggatcggtttccgggagcctctcttctgccaggataataccggatgaaccagtccgctccctgacattcatcggaattttcgaaaccgggatttcaggcggtgagggagtaattggctgcagagactcatcttcatcctcatcaggaagagaaaatcctgaaaaattgtcctgtcctgccgttctgctcaccaggaagtcgacataatcttcaacctgggctctgagccggggacttaaacctgcaatcttctcctcaagactcatacaatcaccggaatgttggaaccagggagagcactctgcaggcatgttctgccagtgaggtatacagataagcctcttcaagagttttcccggttgcaaaggtcccatgacccctggcaatgcacagaccggtcaatgccagacagtcagccacgtcatcggccagttccctgctccccggctcaccaacggcaatcggaatcgtaggacagaacatcttcccctcactatcaaggggagttatctcatcaaggactaaagatgcagcgacggcataggggggatgggcatgcacgatggcccggtgccgtgtctgctggtacactgaccggtgaacccgccattcactcgatgcttcagaggggacatccccaaagagggggacacggataagatcacctggctcatccaggtatgaaccggatctcgtgataagaaaactctcctcttcgtcacggatactcatatttccaaagtttcccccgaccagatgctctgaaaagagacgttttcctatccgggtaaattcttcagatgtcatatcttacacaaaccggattccgacatccttcattttgttgaaccgtgcaatattcagaaggagcggagtgatactctctacaatatgtgatgaagagagcgggccggcatcatatgccttcaaagaagatatctgatttaccagatccataacgatctgctttgcctctgcatcatccccacagacgggaaccgaatactcaagttcgcttgagatatctctccaccggtttcctgcaatattattaaatgccgtgcatatccgggtggttttcggaagaatgttctggaggaagagtgctgccgaaccctccgccgggggagtatatacaaagcactcacgccgctccatcgggtttaccggactgataactatctttccttcccagcctgatatgccttcgacggtggatttcagatgtttaaaggggattgccagtatgattacatcagactcccttacaacgtcctgattatttccggatctgaccgagcagtcaataccccgttctttggcagagataagacaggtatcacaggtctcctgtgcttttcccggatcccgggatccgacacagacatccatgatccaggacagccgcatcgccatcccttcaccaatctctccggtccctccgacgattccaacccgcacgttatgccaccaggggtcggagaaccgattccagggtatctgcctctgtcactccctggaacttctgaaccacaataccatctttctcaatgatgattgtcggaacaacagagatgtggtaattctgggcttcagccatatgctcatcaacattgatcttgcgtatctccacaagatcccccatgcggtttttgagctcttcaagaatcgggcccattcgcttgcacggtccgcaccattcagcatagaagtccataagaatcggttttgacatgctgcaccttagctgaattgcgttaaaaaaacagataaaagtatggtatcggttatttggagaggatagacatgataatccgcccatatgccggacgagttaccagaacacccactaaaacaccgagaatggtaatgattgcaaagccacgcagggttgaaagatccataacagccaggggaagcatggcgataagaaccgttcctgcggatgctacaatgataccaagagcccgtttcagccgtttcagatacagattcggcgacggcacctttccttcatgcaggatttcatcagtgatgatcaccagctggtcaattcctgtacccagaaccgcaatcagaccggcgatggtcgcaaggtccagctgcatgaagaaggtcgtgaatgcaagtaggatgatgatttcagaaccattgatgagcaccatagggaagacgatacccggctcgcgatacctgataaacacactgaaagcaacagcgagaagtgcaaatacaccggcaaggacgctccagaatttgaactgatcaccaagttcaggtgaaacagacccggatccggcaatggtcacaccaaccggcagcgcaccatttctcagatgaatctcaagaagcttggcctgctcccgtccttcttcacccacaccggttgaggcaagcaggtttgaggttggccgtgtctgcagttctgcagcaaggtctggtgaaagcggagcggaatagaccacatttccatcaaggatcatatccagattatggccttctggtttcttggttgcaccaactcttatggcagcctgccgaagctcctctgctgcatcatgagttatgacaaaggacactccccagttattactattcggcggtgtctgggaggggtttgcaacagactggatggcatcaccaaagaggacatgttctgtctcattgccggtggtgtggatacgaatctcaaacttaccctgttttccgacaatctcctgggcttctcccatcgagaccccggccatctcaatacggatgtaccggctgatgccattgagagcagtgatgacgtagacctttgcatcacgggtcccaagactgttgatcttgttctccaggatgcgcttcacatcatctgcggtctccttagtcactccgggattgaacgagacaagttcggtgttcagctcggccattatcgcacgaagatcttcttcagagatgccgctcctgatttcaaccgtattctgatcaatcaggttcacttctgcatcaagacgggtcttcagctcagggatgagtttatcaagcgtctgatctgacttgaacgtcacgatggctgactgaaactcaagctgaatccaggagccaccatcaaggtcaaggccaaactgaagattagtatcaagtccggacgggcccgggtggggaaagataacaattatcgatgcaatcagcagaaccaggtacagtgctacccggtaatcctttatcatgtcaacaaaggtgtctttatccatttatgcaccccgctgaccggatgataatcggcctttgccctcggtcatgtaccacttgataatacctgcattggtaagccaggtgttcatgacatcaaagaagagaccaatcagcagaactgacgcaatctcaaagatgatctgaatgcccccgatggccgaaaccgcccacatggcaaggatggcaccaagtgttgtggtggtcatgatgataccggtccgaaaagcaccctccatcttctcgtcaaatttgcccttccgtttcaggacacgggatgtcagcaagatatcactatccaccgaataaccgataagcattaacaaagcagccgttgttccaagggagagctgaatccccaggatattcatagctgcaccggtcatgaccatgtcagcaaacgccgaaataaccactgcagctgccgggacaaaggtccggaatacggcaaacacaacaatggccatcccgatgaacgagatgatcagcgcgattatcgcctgttcctgaagagtttttccaaatgatgagccgatctgatctatttttgcaccggaatatttctcttcaacctttttggtaaatgctctggcggtcgtatcatccataggcccgaacttcagatacttgccgttgttaatcccttcatttatgctgataaggggatatcctgaaaaatattcctttagtacttcaggactttcatcggttacaatcgtaacactgataccgccctgaaattctatccccggactaaccggaagaccggtctgcatccacatcatcccgactgacactagtgataataccaggatcaccatcggaatgatacagagcttcatcggagagatggagctgatatcataggtgaaaaaattcatgcgcagaagggttagagccctatcattatagtaattggcacaccgtttcaaaagtccatttccgaaaagtgcggatatcgttcagaccctgacgcaatctcattcttactcatgctacttgcggattctatggaggcaccatacatgattcagacaatgtacaaatcagagtgattcaggttatttgagaagaaaccttatgatcggcggatttgaaaccggatgatatgacattccactcaagacagcatgtagtagagcagagactgaaagcctggttatcaggggatccaaatggcgtcaggcgtgctgctctttcattatttctccagtatggagatctcaccatcgaggatgtatatgagcggctggctcccgtatacccggtctcgtaccatggtgttggggggatgatcggacttatttcatcgaggattggcattctgcaagggattagggatgataagaggcgatgcagatcctaccggctgagagagaaggatcgtgcctcagtcagagagatcatgaccgcttaaaacctgaaggcacaaccattttttcccatccggtatcaccttttttggatgtccgaactgaaagccggcctgtacgaggaggctggttatcactcgattcatatcgacgacgatgtgatcgagtatatgaaagaacgaaatactgattttcgaatctcaacctcatgtggcgggccggtccttcttcccatctcatacaaaccaccaaaaccaagtgaccttgcattacgggcaggtgagcgcactatatatatctctatgtaccaggctagatacattgaccatatccatatgggtctgatcccctaccacatcgggatgagggacgaaggattctctgaagattataacgggttctgatgagctttgaagagagggaccatactgcagatattctgatgcatatcagggcagcggatactatcgggctttttaccgatgcaggccatgccctcatgaagacgatgtaccggggccctgcaagacccattgaagaagtgtctgtcaccattaccggccagtctctggaacacctccttcatggattcctctctgaactcctgtttgaatcagaggttcagaatatcgtcttctgcgagtttgaatttcagatacgcgaaggtgaagtcagagcaatcctccggggagagccatttgatcctgcgatccacgggggagggactgaagtgaaggggatctcctggtatgggctttccatcaggcaggaacagaatgaatatgcctgcgacgtattgtttgatgtgtgagggactggtatgattgaaggtgttgtaagaaagggagaatatgaatgggagttgccggtcgggtttatccctgggatgcatgttccgggccggttttttctatctgatgaactgacaaagacactggaggaaggtgcccttcagcagcttgcacatgtcgcaaccatgccgggaataattcataactcccttgccatgccggatatccactggggatacggctttcccatcgggggtgtggctgcatttgaatatgagaccggcgtcatctcccccggcggggtggggtttgatatcaactgcggggtcagacttctcacaacacccctgaaaccatcagaccttgctcaaaagaaagagatcctggacaatctgttcgacgcagtccccgtcggagtgggtgcacgctcttcccttcgtctctcagaaaagcagcttgagaagatgatgactgatggtgcccgctttgcagttgcagaggggtatggaaattctgatgatatcacccactgtgaagaacagggacggatgaaagaagctgaccctgcccatgtctcgcgaaaagccaggtcacgaggggttccccagagcgggacactgggcgcggggaatcactttcttgagatacaggtcgtcgaggagatctatgatgaagaggccgcacggacctttggagttgaacagggccaggtctgcatgatggtacattgtggatcccgtggccttggtcaccaggtctgtactgatcatcttcaggtgcttgagcatgcagtctcaaaatatcacatccagctccctgacaagcagcttgcctgtgcccccctcacatcaccggagggaaaagcatactttggcgggatggctgcagcagcgaattatgcctgggccaaccggcagatcatcacccatcagattcggtcagtcctcaccagaatgtccggaatcggctatgatgacatccggcttgtctatgatgttgctcacaacgttgcaaagattgaagagcatgagatagatggaaagacaaggaaggtctgtgtccaccggaaaggtgcaacccgtgcctttggtccaaaatgtccggatgttcctgcagattacacacatgtcggccaaccggtaataatcccgggaagcatgggctcatcctcgtatttactcaaagggaccgatgttgccatgaaccggacctttggctctacctgccatggcgcaggtcgggtgctctcccgatcccaggccaagaagaagatccaggggaaaaatatcagggaaactctcggaagagcgggaatcatggttaaggcaccccatgacggggcgattgcagaagaggcgccggatgcatacaaatcatcatctgaagtggtatcggtggtccataacctcgggctgtcaagacttgtggcgcggcttgaaccactcggcgtaatcaagggataaatgacattgcaggtcgcggtcatctgggaaggcccggtactctttacccgcctcattgaagaatgcggccactcctgtgaactggtaaccccgcatcttctggccgccccgtttttcagacgcagactgcacgggcttgtaattcctgccggatttgcatctcccggacatacgccggttcttgcagcattacgggcgatacgtcctcgaatcagaagatatgtggaagaaggcgggacactcctctcatttggggcaggagcagatcatcccactgcatatgactggctgccggtccaggtcttgtaccggtatgggtttgccacgacaagagtggagagtcagaagagccatccctttctttccattattgaagatggggaagaggaagtctcaatcgatggcattctggacccctgtgccggtgaagaggacaggcaggtcatcctgcaggcaccgaacggtccggtcatgctggatatcccatttggaaaaggcaggattctgattgccagcctgcatgaatacccgtcccggcggtttgtccgtgagttctgcgctggtgaaggcgaaggattattgtaatcagacacaagggaattattgagggaagatgatgagccgttatatcttatctgatcaggccgaggcaaccgactggataccggtctgtatggccattcatgagatggtcggaaaactgccggtgacagcccgatctcttgagaaacggggtatccggatagaagacggggtagttgttgatgatgattactcaggaccaattcttgaagaggtgctggcagccggagagatccgcaaagttactccatcaacaggtcaatataaagggatcccggttattgtagcccccctgaaagatgataccggaaagaccattgccgcaatcggtctggtggatataacaggaatatttgaccttgcaacgctcatggagcatcagtccaccatcatcagacaggtctgtggcaaagacccctgcccccttccgacagagcagatcagggcaaagcggtgatattcacatgtatacgcaggcatttaaagtccttgagattcttgagagatccgataaaccagttgagaccagtgagatagcagaggcgctgtccctttcaaaatcggcagtctggaaacatatcaatgagctgcgccagcttggatatgatattaccgcgagtggtgaggaggggtacgtcctccatgacaagaaccaggactaccgtccgcatatcatctataaacacctgaaaaccaaattcatcggcaggaaaatgcggtttttcgagagcatcccgtccaccatctggtatggcaaggatcttgccgagcagggcggtattgatgagatgaacgggatggtcatcatcgcagaggagcagaccggaggcattggcagaatggggagggcctgggtatcccccgccggtggtatctgggtgacaataatcctgcagccccagatcccgattgaacagctcttcatgctcacccttgcagcatcagtctctgttgcccgggtgcttcgcaagatgtatgacatcggtgccctcatcaaatggcccaatgacatcatcatcggtgacaagaaggtcgccggtatcctccttgaactcggcgcagaggagaggaaggttgagtattgtctggttggcatcggcattgatgcgaacgtgaaccttgagtcattaaaccagaccatcaggagcaccatgacctccatcagccaggaagtgaaccagaatgtggaccgtgccgttcttcttgctgccatcctgaaagagtttgagaaccggtatgagatgatatcacaaggagagtttgatgcggtcatcagggaatggaaaaacttctcttcaacaataggtcggcgagtcaggattgtcacgttgaggacgcattttgagggagaagcaatagacatcgacccaaacggtgcgctcgtcgtcaagaaggacaacgggaagatagagcgggttattgcaggggactgcattcatatctgaaatggccggaaattatcatcgatcgatcatcatcacccataccaccctctttatcgcgatgaccacggtcttctcctggatctcaatcccttttattccggtcccgataacgctgcagaccatggcagtgctcctgaccggcacgattatgaaacggtatgcaggcatcccgatggcgctctatctccttcttggtgcgatcggccttccggtatttcataacgggactgcaggccttggggtgcttctcggaccaaccggaggatacctggtcgggtttattccggctgcaattctagttggtctctgctatgagcaggtttcggaaaagattcagatagcaggactggcccttggaacgttcataatctatctctgtggcctctcatggctcgtcatttcagttcctatgaatctgactgctgccatcaccgccgggatgctgccttttcttcctggtgacatcatcaaagcggctgcggcatttctcatcaccaggcgtatcctgccttacacaacgcggctttcagatccatgattgagattcgatcggtcagggcaggtatacttaaaatcccgtcctgtacgattcatcccggtatctgtgcgatagccggccccaacggtgcaggaaagactacttttttaaaactcctctcagggattctgcctgcgaagagtggttctgtaagcattgacggaaaagagccgtctgcatgtacgattgggtgggttggtgagtaccctgaccggaacatcctctttccacgagtctatgatgaactggcaagttcgctcagatttacctggcagtcctgtgagtcttctgatctgaaggtcagaaaatgtgctcatgatcttggtatcacccatctgctggatcgtgacatccatggcctttctggcggtgaactcatcctggtcgccttcgccgccgcctgcatcgcatcacctgacctgctcatccttgacgagactgattcccaccttgacgagcgattctgccaccatcttgaggaatttatcagaagctcaggaatacggtatgtcgtcttctccacgcaccggcctgaacagatggcgattgcagacgagatgatacggctggtcaggggagaggttgccgagcatctctccctcacagaggagtcagactatgcattcccggatcacctgagtaacccctggttctggaggaaggttcagaccgaactgtcgaaagggggcacatgaatacaccccagataaggctgaccggagtgagcagaaagagaggtgcattcacccttcaggccgatgcagagttcggagctggtatccatctcctgaccggacgggtgggatcagggaaaaccacactgggagaactcctggctggaatcggagaacctgattttggaaccatccaatggaacgggggcaggagagtcatgcttttgcaggataccagttatcatatcagcaccatgaccgtgcaggaagaggcaggaagctggcaaggtgatgctgaaagaatcatccggactgccgggctgaccggaaaagaacataccgatctcctgaggctttcacggggagaggtccgaagacttgagctggctgccattctcaccgggcagtatgatctcatcgtccttgatgaaccatgggcagggcttgatgaagaggcacgccgctgggtcaggcagctcattgactctcatgcgcatgagatcatcgtgatcatcagccatgatctcacctcgctcccgcatatagaccagctctgggagatggaatgcggaagactgaaacggcttgggcaggtacctgcatgtctttctaagtggacaaaggcgcctccccttgtcagatatctcctgaataagggagtgcatctatccgggctgtcacgggaggaactagaggaggcggtatgcaggatccccggataagactggttacaacaatcctgctctctgctgcagcctggatctcgctccccggtgccgtcctctccgtcctctggtggctgatatgcggaaaagcacggacctcaatccggtctatccgatcctttttcatcatcctcatcgtgccgggattgatgggacttgctgcagtatggtctggtgaagacggtctctcatatgtggtcaggatcatggcggtgctcatcatcgcgtcatggatgtatgccgagcggtatccgggagaacttcttgatgtgggagtctggtttctcggaacaaaaaccggatttgatctcgggcttatcggggagctgagtatgtcttcccttgatacccttgcacgggagacagaccggatttctgtcgcccttcggcagaaaggaacacccctttctctgcgtatgatcccggctgtcttttcaggcatactcatcaggcagctgaatctggctcatgaacgggcaattcttctgacactccggggatataccaggggaggcatgcattgcccgtccttttcctctccgggtatagaccggataaacggggccttttcatgcaccattttccttttatccctgattgcaggtgacttttttaatatagccggatcaacctttattgtttgaaccgcaccctggcggtataataggtgtccatatgagttctgaccgacaaaaacggctttatataacagatacaacacttcgggatgcgcaccagtcactcatcgcaaccagaatgcgaactgaggacatgatcccgctgacccgctcaattgataaggccggtttcttctcggttgaagcatggggaggggccacgtttgacagctgtatcaggtttttgaacgaagacccctgggaacgtctgcaaaaactcaaggcagaactgaaacacacgccaatacagatgcttctgcgtgggcagaacctggtcggataccggcactattctgatgatgtggtggatcggtttgttgacctcgcccataaaaacggggtagatatcttccgggtctttgatgccctgaatgatatcaggaacatggagcgcccgatgaccagggtaaaggagactggtgcccaccttcagggaaccatatcatatacaaccagtccggttcactcagtcaggggatttgtggatctcgcccgtgaactctatgcccgtgactgcgactccatctgtatcaaggatatggccggacttatcatgccggctgttgcaaaagaactcatcatgggcatcaaggatgagatggatgtgctcgttaacctccacagccattgtacgagcggtattgcgccgatgtcatatagcgctgccatcgatgcaggggtggatattctcgataccgccatgtcaccctttgcccttggaaccagccagccacctaccgagagtgttgttgcatcagttcagggaacagccagggataccggtatcaatctcatggatctcagagtgatcaggaacgagtgcctgaagattcggaataaatatgagggacttttcactccgattgccgagcgggtggacagcgatgtcctcatctaccagctgcctggtggaatgatcacaaatcttgtctcccagctgcaggaccaggatgcgctcgataaaatggaagcagtgcttgacgagatcccaagagtcagacaagacctcggatatccccccctggtcaccccgacctcgcagattgtcggaacccaggcagtattcaatgttctgaccggagggaggtacaagacgatctcaaacgaggtcaaggactatgtaaaagggcagtatggaagatctcccggtccgatatcagatgagatccgaacgatcatcatcggggatgaggaggtcatcaccgttcggcctgcagacctgcttgcaccaatgtacgagaagatgaaggcagaagcaactggtgcaggtctgataaaaaaggaagaagatgtcctcacctatatcctctatcctgccatcgcgccctcattcctgaaaggagagcggaaagcagagccgattccctccgctgtccaaaagaaggagaccagtctttcaatgccttcatccatgcaggtcgaagttgacggggagacattcaccgtcaggattctcgccattggggatcagccggttgaaggaaaacagaaagcagccgaaccaccaaaatcggacattccaggcggggtcaagagtaatatgcagggaatggttctgaagatcatggtcggcaggggtgacaaagtaaaggcaggtgatactctggttgttcttgaagccatgaagatggaaaaccccatctcaagtccacgggacggagtggtaaaagagatctttgtcgatgccggagacaccgtccttgccggtgatgtgctcctggtggttgaatgaaatatttcgagaagatactgatcgcaaaccgtggtgaaatctccatccgtgtcatgcgtgcctgccgtgagttaggcattgatacggttgctatctactccgaagcagacaaggactccctttttgtccattatgcagacgaagcctttccggtcgggccggcacctccttcaaaatcatacctgaacaaggaacggatcatatcagttgcaaagaaggcaggcgccgaagcgatccacccgggctatggatttcttgcagagaatgcggagtttgccaaactctgtaccgaagagggcatcaccttcatcggtccgaaatccaaaaccatcgccgcgatgggatcaaagatccggtcaaagcagaccatgaaaggtgccggtgtcccagttcttccaggaactgacggagggattgatgatcttgatatggctgcaacggttgctgactccatcggatacccggttatcgtcaaggcaagcgcgggtggcggcggtatcgggatgcagatcgttcatgatccctctgaaatagaatccgccatcgaaggtgccatgcggatcgcagagtcggcattcggtgaccggacagtattcatcgagaagtatcttcagaaaccacggcatgttgaagtgcaggtcttctgtgatgaacatgataaccgcatccatatgtttgaacgggagtgctccatccagcgccgacaccagaagctcattgaggaggcaccctgtccggtcatgacccctgagttgcgtgagaggatgaccaattctgcgctccgggttgccgaggcggtggattacgtcaatgccggcacagttgagttcctctatgacaatggcgagtattacttcatggagatgaacacccgactgcaggtggagcataccatcaccgaactggtcaccgggatcgatattgtgaaggaacagatcattgtcgcgtcaggagatcccatcgaatacggccaggaggacattactctgcgcggtcatgcaatcgaatgccgaatcaatgcagaggatcccatgaacaatttcgctgcagatcccggcaagatcaccaggtaccggtcaccaggtggtccggggatcaggctggattctggtattcatgccgggtataccatcccgccattctatgactcaatgatctccaagctctgcgcgtggggaatgagcagggagtatgccattgcgcggatgagacgcgcaatttacgagtatgtcatcctgggagttaagaccactttgcccctgcaccatgccatcattcacaacccagagttcatcgctggcaacacgcacacccacttcctgcaggaggaacatatcagccggacccttaagcggtacattcaggaagaggagaccaggatgacccagctggcaacgccccttcgtgcagacaaaaaagttgccgcgattgctgccggacttgtggcggttatcgaacagaacaagcagaactgatgcggcgaaaggacaaggaacttaccgatacggaacggatcgaagagatcctaaccggcgcacttttttgtcatgtcgctctgtgtgatcatgaccggccttattgtgttccaatgtgtcttgcataccatgacgggaagatcctgcttcactcagcagatgcaggaagaaagatcgatatccttcacaccaatccacacgtgtgcatcatagtcgagaccgggatccaatgatcaccggagagcgcccatgcgagtatggtatggcatatgagagtgtgatgatcgaagggactgcatcatttctcagaggcgacgggaaagtccgggcactggagcagatagccatgcagtatgcacatgaaactggcgcgccgtacacaaaagaacagaactccggtatcgccgtgatagaagttatcatcacatcctgcaccggccgaagatcaggatctgttccctcctgacctgaccagaaacacaatctcaccaccccatgggcagaacctgatcaggtatggtggcatcggcgctgatcgtgaacaggtgatctcgttgccggttatgagcgcagcatgattctcccggatacacctcatgacctcttgtggagctgatgactggttctcccagagggacccttcaatgatagatccatcggatttaacgactgcatacccgtttatagaattatcagccctggaatgaataaggcgggccagagttttcccaagccacccggacaatgcctcaagaaatgggcgctcacgaaccgggatctccggaagggtatgggatcccagattcagacacccaataagaatgctgtgttcatataggggaatgagaacatatgacaggattccttccttctccagaagagtgcgaatcttttctgccgaagggtcagagacggaaatatagcggggcgccccgttgtcaaacaatgtcaggatatattcgtttacaaccatctcactgactgcactgatgtactcctctgaaagcccggcatgacagtggagatgtaaaaccgggacatcgtcgtatttatggaggatgtagagccccccggaatctatgccagggacttcaagtgctgtgcgcaatatgagatccagagcatgatgcatatcggtcgttgccgcaagttccctggcaagatcgcggtgtgcctgcagatgctcagaacgccgtatctgatcagtaatatcacgaatcaccaccccgataagatcttcacccacagggaaggccttgaaagaataattcccttcaaataattcagaaaacccctcaaactcgacttcatcaccagaacgggctacctgcagcagggcatcccgccaccggtgatcaatatcaggacggaaatcagagaggttccttccgatcaaatcctttttctgccatttaatccgatgaactgcaaactggttcagatccgtgatgcagaaatcacaaactgtcccgtcagatgcatgaaccggtgaaaaaacaacatacccttcgtgcattgcatcaaaaagccgtcgataccgttgttcattcagcgtctccctgcgcttttgatggatgaaattatgaacatcgatagctgccccgataagtccggttatctcatcacgttcatttctgaacggtcgtatgtacaattgtgttgggtagggtttccccccaaactgaattgaacactcaccagcgaaaccttcaccagattcaagaacccgtttttttatcgcatataattcacgcgcagtatccgggggaaagatctcataatcggtatatccgatgatatcagaggtgcttagattaattgagggattaaccacccactgatacaccatatccggatcctggccgaaaatggtaaccggcgcagcatggactgccagttgaaacttttcattaatctgccttatctcatcctgaatccgtttctcatgggtgatatccgtaacaacccctatctcccggaccggggtttgactcttgtcacggacatagtggatctttacccgaacccatctgacctcgccggatggaagtacaatccggtattccatcctcttccggtctcctactggaacacctgcctgcgctaccacccggtcataatcatccggatgaatagaggaggtccaggattcgggatcatcatacagctctttcaccggcttttgatagatctcctcatatgcctggttcagatactcgatcgatccatcacgtaagttttgcacatacacaacgtcagatatggtctctgcaagctccctgaaccggttctcactctcaaccaaattgtcgagggcatgtatccgcccctggacatctctggccacacaacaacagtactccctccccttgtatgggataagagtaaacctgatctcaacaggcattggtgttgaatcggctctgaccatgcatgtctcaaggacaagacttccctgttcacgtaaagaagagaacaggaggttccagtcaccaaaaggcggatgggtgaggtaggtactgatccagagcttatcggtcttctccgggatagaaagcgcatttctggctgctgtattgtaatacgcgaccagaccatcatccgtgaaccagaagaccagatcacctacattccggatggtatgttcatacatccgaagggtctcttctgtctgtctgcggtcagatatttcattgtataatcgtcggttgatctcacgaaggtcctgtgtccttttcccaaagatcatctcggctgattcaaagaactgatgaaactgttctctctgaaagaactgctcggtatgatccttcccgattgccagatagtgccatacctcatcctcatacgaggcatgaaaggtccagtggtagagcctgatgtcacctgatggatgtatgatccggagatcagttccgtattcaccagtatctcttgcctgacagagtgcgtcattcaggttttcctggtcatggactatcatatcaaagggaagaaatccttcggttccaacagacggggctcttgaaaatgtcctgataaaaccttcatttgcaaaggatatctcaaacgaagatgagaaattcacaattaccggatcggtcaatgcaaagaaccggtcaaggagtttttcacaacatacaaggcgctcactgatcccctcctgaggggcagtctcatgaattatgaccgccgctccggatcttcctgaatcaagctgaacgggaattcctttgatggtatatacaatccggctgcccctgatgtgtttcataacagtgaatgaacaggactgtccccgaagagagggggcaatgccatcagatattcccgtgcatatctgctcatcaagcatcaccgccggacgaccgattaaatcctcttctgatagacccagcagatcaagcgctgcactatttgctgacctgattatcttccctctgtctactccgaataccggttcagagaaaaggcgcagaacacaggagagaggagttcttcgactggagtagtagagtttggttacaccgatcttccggacctcagcaaggccctggctatgaagaatctcaagatacttcgcagcagtgttccgatgaataccaaggtgctctgcaacctcatgaatgctgattccttccggattatcggcaatcagatcatgaaccgcatcaaatccatcagacagaatgtatcacagtcgtactatatgctgtgcatcaggaaaataaatcgtgattcactgtgattatgcacagcgtaatattagaggcagcattatggccgaactgatacctcacctgcaacccatgaaaggtaccgatcatacccatcctttaccgggagacagagcacttcagggatatcatagggatgcatgctgacgagagctgatttgagttcgtcaacttttgcacaggttgtcttgatgacaagcagatcttcaggttcatcacagaccgctccttcccaccggtacaccgaacgtgctgcaaggatattcacacaggcggccaggtgtttgtcaaggacctgggttgccagggtatgcgccataccgggtggagcagtacacaggataaccataacctgattttcggtattgtcttgcatgatctgactgtttctcctgaaaagacttgaggaatatggagagaaaataacgatatatttattagtgcaaacggcattcttataatgcactttgtgctgttgtggcctagctggttagggcgccagactcataagttcaagactgagatatctggaggtcgcgggttcggatcccgtcaacagcattagaacaactagtttggatctcttacatccctttttttaagaggcagtttataccttcagctatgcccctgactcctttcgcaagcgacaatgatcgctttcacctcatgaaaagtgactatccggaccgttcactttcacgcgcaattgagagcggcaccgtcactgagtaggacaaaaactcattctcgaattcatcgctgaacggaagaacaccaagggaatcaaatgcaagcgggttctcaaaatcatctcaagcctgatcacctccaggcgattcatcggaccgtatttccaggacacatacttcgatatctatcaggggattgatgggatcgtgaacggtggtccggtaaagggcaggcaattcacccagaacaccagggtggaccttatcatgattctgaaatccttcgtcctctggatgatcgttaataagtacctccccaatgtaccggaaaagaagaaccgggcgatcaaagtcccccgtatagcccctaccaaggaagcatctgatctcctctcggttacagagatcgaagctctgatgaaggcctgcaccttcaaccggaaccgggcgatgatcatgatgctctatgaaggggcatttcgtgccggtgagatcggggagatgagatggaaggatctcaagattgacgggaccggtcttgtggtgcgtgtgaccttcaagaccgaaaagcaccggtatgtccggcttgttatggcacgggaacatctcataaatggaaatcagaatatcccggcgagatcgttgatgatggatttgtcttcgtatctggcaagatgaaaccgctttctcatgccgcaatcaccagacttatccagcgactggtaaagagggctcagatcaacaagcacattactccccggatcgtttcgaagatttgatggatctccttgaagatattagtgttaaagtcaggtatcatccaatgagaaagagcaaaataactgagtgattctgaaatgaatttttttatatcgtaaaaattaagattattataaatagaattacaaatctgacccagattatatgggtcttcgcagagatctgactggcatcatccctgatgatcttctgatcctccttccggatggatatgaaattatcggcacgatcgctatcatcagcattcctccagaactaacgctattcaatgaacagattgtcactgcactccgggcaagaagaccttcaattcagaccatattgaataagaccggggatgtgaacggactattccggacctcacaatacacacccatatttggtgaaaacaccatcaccgaacatcgggaatatggattcaggtaccgccttgatgtcagcaaggtctatttttcatcaaagatgggatcagaacgcaagcgaatcgcggaccttatcaaatcgggtgaaactgtatttatcccatttgcaggagtaggaccatatgccatccctgtcgcggcacgaggtgctgaggtattggcaatcgagatcaataaaagtgcgtgttcctggatgacaatcaatgctttagaaaatggagtgtcttcacgtcttcacatcatcagaggagatgccatgcaggcaaaccagaccctccgccggaaattctcacggataattattccaacaccctatggactcctgaatggcccggatatatttttatccatgctttccgaggggggaaccgtccattggatttctttttcaaattctatgcagatgaaagagataattgacaggctaaccgagcggggttatcaagtattgcgctgtcatcagtgtggaaatgttgcgccatctgtttatcggtggatccttgatattaaggcaaaatgactgttctttacgaaaattttacaatttttcgtttttaatgggttcgcaggattgaaacagaacgatttgaaatcttttttttattgttaagaaagtatataatgaagataagactagccttaaatatctccctatccaacgaaaactgaggtttaatatggcatccatcggttctggcgtaatcttaatgggtatcgttgtagtgattgggtcactgttctgtttcgcatatgctgatgatgagatctaccctggtggaatggtaatcaccaaatttaacagttctgaaatagggacaatgcaggctgctgaaaagttcaactcatctgaaattggaactatgcagaactctcaaaagttcaactcgtctgaaatagggacaatgcagaactctcaaaagttcaactcatctgaaattggaactatgcagaactctcaaaagttcaactcatctgaaattggaaccatgcagaactctcaaaagttcaactcgtctgaaattggaaccatgcagaactctcaaaagttcaactcatctgaaattggaactatgcagaactcaaaaaagttcaactcatctgaaattggaaccatgcagaactctcaaaagttcaactcgtctgaaattggaaccatgcagaactcaaaaaagttcaactcatctgaaattggaactatgcagaactcaaaaaagttcaactcatctgaaattggaaccatgcagaactctcaaaagttcaactcgtctgaaattggaactatgcaggacgctaccaaatttaacagttccatgatcggtactatgcaaaacaccgtctcaaatattcctctcccgccaggagtgacagtttaaatttattccaattttttttattcattttagggtaactaaatcattttatttattatcgcatttcatctctcattttcttaaaagaaagattatccttaaatatctctatcacaaacgatttctgaggatatattatggcaaccctccgatcaggtatacttgctttgatagtatgcgcaatagttgcttctttgctcagttttgcatacgcagatgatgtgatctacccaggtgggatgatcattacaaaatttaacagttctgagattggatcaatgcatccacctgaaaagttcaacagctcagagattgcatcaatgcacacacctgaaaagttcaacagctcagagattgcatcaatgcatccacctgaaaagttcaacagctcagagattgcatcaatgcatccacctgaaaagttcaacagctcagagatcgcatcaatgcatccacctgaaaagttcaacagctcagagattgcatcaatgcatccaccagaaaagttcaacagctcagagatcgcatcaatgcacacacctgaaaagttcaacagctcagagatcgcatcaatgcagaaaccaaattcaactgtcccccttccaccaggggtttctatctaatttttcccgatctttgtcgctttgagtgctatttttttacttatacatcgatgagatgatatgcaggctcatcatgtcctatttatctttcttatcctgcttctcctgttctgcggttgtattacagatacaaatgtaaccgctccagatacagaatcaggcacaccggatacccttgcaactcttcagagtttactggaatcagatcctgaaaaccctgatctctggtatgcaatggctgagatactaaaagaacaaggtgataacgaaggggcaatacatgcaatcaccagagccgctgaattcagccctggaaacagcacaatcctgcttgcaaaagcgcacctccacataacgaaaggagagagagatcaggcaaaccgtgccatcctgaaagtccttgatatccttcccgggaacaaaaccgctttagaccttttatcatccttgcgaatgaacacaacaactcccctgaactatatcctggtcgaacatgatctcctgatcgaaccaaataatacttggtcagcctttaataaagggcgcctgctttttgaagaggggaaacaccgtgaggcacttgcctggttcatcaaagctaccacctatgatcagaagaacgcacctgcctggtacttcaccggaacaacatataccgaactgggaaattatgcgcaggcaatcgatgctttgcaatcggcactgacacttgatccctcaaatgccggtgcctattatgagatgggcagggcgtatgaaaaactgggaaaccgcaccgcagccaggaattattatgaaactgcgataaaattaaatccggataatgtatggacacgatttgtttatggaaaaaacctggccatctctggtgactacgaatctgcaataaaggagctgaaaacaagtcttaaaggatcatcatgtcaggcatcagcctggtatgaactcgccaatgcatattaccagaccggacagtatgaccaggctcttgaggctatcaactctgcactcaccattgacccatatacaaaagaataccgggctttgtacctctctatacgggcagcacaggatcccgcctcctggtcactgcaaaatgtaacaaaaagagctgttgatgcacctgaaaatgcatcggtttggttctatcagggcgcgattgcatatcatgacgggaggtatgcagatgcactcacgtacctcacctctgcggtcagtctggatccgatgaatccggaggcatggtactaccggggagtgacccagtatgaacttggcaggtatcaggatgcattatgcagctttgataaaacgatactcctggatcccggaaatgcatgggcatattactaccggggtgatatcctgcagaaagggggacagtgtgaatacgctattgcctatctgaataagggaatacaactggatcctactattccctggacatattatgtgaaagggaactgttacctgaaccagagcagatatcaacttgctgcagatgaatttgacagatcaattgaccagttcccctgtaaccgctgggcatggttctttggagggcagagttattacggactcggaaaattttccatcgcctatgattactttacaaaagccctgtcatttgatcctgaaaatgaggagttcagaaggtggaaggcacgggcagctgcagagtcatcgtatccggatgaggcaatctatcactacaaccagaccctcccgttctcaaccggtgcctgtggcatcatgtaaccttttttttagagagacgaatctatcacagggatctgtgcgccggtcctgagtactctgaataccttcacctgggtaactccggaaccaccattcagggagagtgttcctggtgtagtatcgatatttttcgaatactccctctctcctgagccgatagtgaccacataatagtcaccttccggaagactcttttctgcagttatgataatccggtttaccaggggatcatatctgacgataagaccaggctctccaggtgcggagatcttgcttgcaggcctgtctggttggaacgtaggaccagcggtgatctcctgcgttaaagtaggtttaggaagtatgaccggtggtgaggttgagtacggaccgggtattgcttcataattgagaagcctcacatcccttccggactgataatctttcagcggtttcatcacctggtttaatcctgggatctttgtaatcgtgaaatggtctgtcaccggcttatattctagtacaccaaagagaaccaaggcaaaaaggatgaggagaacggtaagccccaccgagaatgcaatctgcgttccggtggcttttcgcgcgccccggtcaacctccggagatttcacctctatccacttgatcggttttgaaaaccgctcagggtgttctatcaataactgctcgtgaacaatctcagtgccatggctggtcttctcccatttatagggcttaaagataagctgcagggttcccttccatgcgccgatactcatgagtatccagtatatcggtgaaaagaacgcatacagaagaagatcccgttgtttctccttccatgttgcaaccaccatcatggtgaggaagaagagattaccaatcagcaggttaaagactgcaatcgccgcaaatggccagaagtcaaaccagctggagaaatattccggtatgataaaccctgccgcaaagaccagccagaggaagaggttcatcagggggaggtaaaagttgcccccaaagccggtctgaaagataaaaaaattcttgattccgatatctttcaggacttttatcgggtgtcgcatcgtcacaaaccaggtgatcacaaaccctttcacccatcttgagcgctgccggatccatgaggggacccttgtgaccgcctcttcataggtatgtgaattcagcactgctgtgtgcaactttttacgcgcgatccgcataccaaggtcagcatcttcagttacgttgtagggatcccatgcacccagctcacggagggtcttcatcctgaagtggttgcttgttccaccaagagggataggcgcatcaattttatccaggccctggatgtaaaaatcatagtaataggaatattctattgaaaaccaccgggtcagcatattcttccgtgggttgtagaaattcaaaaggcactggacacaggcgtattttggaccaagacgctggaatgctatgacgaccttttttagctgatcccggtcagggagatcctccgcatcgtaaatgacgacaaactcgccacgtgagcgtttcagcccataattgcaggcccggggtttggtagtgatatctgcctttgggatgacaaccggatgaaagatacttaagaatgcgtgatattcgggctctgacatcggggagatgatctcttccacatttccaaagagtcctaattttcgcgccttttcaatcgtctccgtatcttcctcttccatcaggatttttacatcgagcttatcacgaggataattgatattggcaatattctgaaggatatgggggagcatctcctgctcatggaagagtggaacaaggacggtataaatggggagatcctcatctttgaggttttgaatatcctcatcagagatgtgaatgacattcttctctcccatcatcccctgcatagagacatagaatttcaccgggttcatcacgaaatacgtgatattaacgatagtaaagaggacaaaaagccagaaatagggatttattgcaatgagaaggagaagaaggatagtaccaatgataattaccgctttctgccagggtacaaggatacggaacgccgactcatcaggctgacgatccaccagttcactgagcgcactatatgcgtggggacccttataactcgtatcagtgattgtaaggatggcatcgagtggcgttactactttttcaattttttttccgaatatctcttcgagccgggtgaataagggagtgtccaggggatttgccgttgctaccttcaggtaggtcggtttggattcaagaagagctataagcgtctcctcaccgactgcatatggaagaacagagccgatccgtggatttgcaaaaagagtatcgcgctccatgaaagccagccccagccggtcagcaagatatgcatagaaatcatccggagcctgaatcctgaatttttttattgcaagtatgaaagtatcaagagtgatggatggatcttcaagcaggactgtattgggaacatccatctgctgtaaggtagtgattaactcttccttggtaaggtcgctcatgatggcactttatctgattgagagaaggcgttcttctaagaattctgccactttgtcgccatcgacaatttgatccttctcctgctcgtccagtttttcctttatcttttccagaagatctctcgggttaaccggtttcataatatatgcatcagccccggcattcagtgagaatacagagttctcaaggcttgcatatccggtgaccatgatcttcttcattcccggccggagtttatgggctttttcaagaagttcagtcccttccatatcaggaagttttatgtcaaagagtgccaggttaaaaaactcattctctatctttgcaagaccttcccctgccgtcgcagcaatttcaacttcatacccttcaaattcaaggatttgctttgtactgtcaaggatggctgtatcatcgtctacaataagtattctcttcatgtgaacctcccataatacccctatgatgccggaagagagacttcaaatgtagtccctgcaggtgatgtttccacaagggtaatttttcctccatgtgcttcaatcaatcgcttggtcaccgataatccaaggccagtccctttcggttttgtggtaaataagggatcaaatatccggctctgcgcttctgcggagatccctggcccggtatcacgaatcgagataatgatatcgtcttcggcaatgtgcgaggtaagggtaagcgtccctccggtatccattgcctggatggcattgatcatcagattttccataaccctggagagaagaaccggatctaccaatactatcataccggattgtatctcgatttttaccagaactgaaggaggaggagatatcttcaggatcaggtcctcaatgaatgttttcagattaatgcgtgatttttccgggtttacctcacgggcatagtcctgaagatcagaaataattttattaagatattgaatttcagtaccaatcctatcgaagatttcaggaattccattccgatgaagtatttctagctcttctttgctcatcttctgcattctcatctccagcagatactgcatattggttataacctggagagggtttctcatatcatgaccgatcatcgtcgcaagttcaccgattaccgcaaacctctgggcgacctgtaactgccttgtccgctcttcgacaagttcttcgagatgacgggtatagagttcaagccggtttcgcgttctgaataattcaacagactgggcgatcttctgcgcctgctcattaaaaatgatacagacatcatgttctgcaggtgaattcggaacaggattttgcgaaaacgtttccaggatctcacgatcacggtccgtgatgttaaagagaagaaagggttttttctgatcaaactgttgtaatttcaaatgcagggtgatggcatccatgtcatcaagatcataatctgaaagaattacatcatagggagtattgcgcacaagatcctgggccatagccccagaagtacacacggtgacgttcaggagcccggggcgttcaagatatgttttggagagctcacccagaggtttggaacttattacaaagaggacctgaaacttttctccggtggtgattggtaacggaaaaccaagttcagggtccatgttcttctcctagtgtgatacaagaattattatcggagggcatggataataattcagagtatggtacattctgcattccaggaattatttcatccgattcatgcagaaaaaaaccatacttacttgtattcaggtagagtattcattctcttatttcttcttatctggatccccggttgttcaggtgatatgatccatctttgcattccaaaagaaggaacactctggaatggtgcattttccccagtgaaatatcatctgcatgagatggatataacaaatgagagcattcgttcatatgtaaatagttcggggaaaaaccttggggttattgcattttctcatgagtggagcataaacagaagcttcccgattgaaaaggtgcagatgattcatgcaaatggagcaatcccttatatcagactgatgcttcgctctgataataatcaataccgacccgaatcactctttactctgaaacggattttcaacgggatatatgacagagaccttatcgaatttgcccgtacagcaaagagaatgaattttccaatagtaattgagtatggaactgaggtgaatggctggtggttttcatggaacggatactggaccggaaaggagaaaggtgcagaattattccgttcagtgtaccgccatatcatcacccttatgcgtgaagagggggcagataatcttatctgggtataccatattaactggcattcaaacccggaagaagactggaataccccggaggcctattatcccggagatgagtatattgatttgattggtgtctccgcgtatggtgccttatctccgaatgaagacaatatactcccgttttcacggatgatggatgaaggatatgcagcagcacaaaatctttcagtaaataagtcagtgcttatttctgaaatgggaactgatcttcgaaatccacataaacctgccagtatttggattgatgaggcattttcagcaataatcaatgaacagagatggccaggtgttatcggatttgtctggtggaatgcagggtggccgaatgataataatcctgtaaataataccacaatgcgaattgaagatgacagagaggtacagaagattcttcagagacacctttcctctgatcaggtgctgagtgcatactgctgatcatgatgagaaatgagtgccagtatgggataccattctataaaacggtcttgctgtacaatagcagcgagggtgatttcccgaggactcgcgtacctcagtaccgtcatccacgtgaggtgtcttaacttccgtgttcggaatgggaacgggtgtgacacacctgctgtggccgctattgaaactgaacaccggtatgacccggttaagcctcgtgcttttaaatcagttacaatagaattttctcgttgaacaatagcagcgaggatgatttcccgaggactcgcgtacctcagtaccgtcatccacgtgaggtgtcttaacttccgtgttcggaatgggaacgggtgtgacacacctgctgtggccgctattgatagccaaactccgggttcgaaccggaattgagttgacctgctgtcaaccgcgtgactgctcagccacttggcctggcttggatgtgtggaagatgcgagatataattacaccagcgtttaaggatttcgtctgggtttgagaaacatgaattgacgttattaagacgattagtattcgcggactgaacacgtcgttgccttcgtgcgtacatcccgaacctatcaaccgggtcttttacccgtgtctttcatgaagtctcttgttcaggctgagtttcaagcttagatgctttcagcttttatctcttggcgcgtagctgcccggcgttgccttgtcagacaaccggtagaccagtggcgccgaatgaaagttcctctcgtactatttcattcttgccttcagacttccaacactccttatagatagtaaccgacctgtctcacgacggtctaaacccagctcacgatcccctttaataggcgaacaacctcacccttggctgctgctgcacagccaggatggaaagaaccgacatcgaggtagcaagccgccgggtcgatatgtgctcttgccggcgacgactctgttatccccggggtagcttttctgtagtcaatagccctcatcaacagggcgtattggttcgttagacccgagtttcctctcgcgatttcttgctatgcgaaatcgcgtcaggccaacttttgctcttgacactcttcagcgggtttctgacccgcttgagttgaccttagggcacccttgatattttttcgagggtgtggcgccccacccaaactgcctacctatcgatgtcctgataaatcagttagaattacaataaaaccaggatggtgtctcatcggtgactaaccaacccccacaagggttggatcgacgtctcccatctaccctgcgcaggtaataccgtaacccaacgacaggctgcagtaaagctccacggggtcttcacttcccataaggagtcactagtctctgcactagtacaaaaggttcaacgggtatgtgttagggacagtatcgctctcgttattccattcatgcaagtcgccaattaagcgacaaggtactacgctaccttaagagggtcatagttacccccgccgtttacgagtccttcgtccggttgaacccggtgttcagatactcgcactgggcaggaatcacagactatacgagtcctttcggagttgcagtctgctatgttgttattagacagtcggagcgatcttgtcactgcgacctgcccaatcgctgggcaggcaccccttatcccaaagttacagggctaatttgccgagttcccttaacacatttactcccgacacgccttcgccttctcagcgaggggcacctgtgtcagttctcggtacggaccgtatcacccttttcacgggctcctggaatcagcattgttaccccatcaccgttttgaaaaattctcaccattacggtactccaatttcatatccggcttagacggagcgatgactccgcaatgcctatccgaaagcgtcaggattgtttgatacaggtacaggaatattaacctgtttccctttcggcgtactcgaattacggtacgtcttaggaccgactaaccctcgactgacgaacattgtcgaggaaacctagcccctgcggcggattggattctcaccaatcttaagcttctactactgccagaattttcattcctacacggtccacaggatcttgcaaccctgcttccgcccatgcaggacgcctctctacgccatcatacaattcgtatggtccgtggtatctgtggcaggcttaagccccgtccattttcagcgccctgaatcttgactggtaagctgttacgcactttttaaagggtagctgcttctaagctcacctcccagttgtctttgacccaggactactttcagtgtttacactgagcctgcactgagggacattaaccacggtctgggttgtctcccttacgcattacaagcttaccccgtaatgcggacttccgatcgtcgctgatgacagggaatttggagtttgacaggagagtgaggaatttcttccccagcttccccaatcagtgctctacctcactgtcgatctcagatcaggtcatgctacggcatgtttcgagaggaaccagctgatgcccggctcgattaatctttcactcctatacgcaggtcacgcgaatgatttgcatatcaaaaccgcttgcggtcctccacgcacctttcggcacgcttcaacctgcccacgcatagatcgccgggcttcgggtcttatcctgctgactccacgcactggtagtacgtcgtccctgaccttacggctgcggacttgttggtttccctctggcttctttcatagaaattaaccgtcgccaacagaataaactctctggcccgttcttcaaaacgtacgatacgacaccggcaacaaaacccgtacttgagtctcgcaactcgttccttcgctttgaagatcctttcgtgccgtatcacgcgataacctgtcagtttcaggcacttttcaacacctttccagggttgcttttcagctttcgctcacgctactactacgctatcggtttcggggagtatttagttttggaggttgatgacccccacattcacgcgggaattccgacccacgctactcaggataccgctaaagtctgcatgcatacacatacgggactgtcaccctctctggtataccgttccaggcaacttcagttctgaatgcaaatcttatgccgcggtccatacaccacatctcccgaaggattcggtttgaactctgtcgtgttcgatcgcctctactaacgacatcccggttggtttcttctcctgcccctactaagatgtttcaattcggggcgttccctttccgatggcggaatgatgctttatgcatctggatgtcctattcggggatctccggttcaatgactccatgcgtctacccggagcttatcgcagcttggcacgcccttcgtcggcacccgaaccgagccatccactgacaggcgtaagaacgtctttttgtagtttcttcaaacccatgtaacgtccagaaacgcctagtgattttctctacgcatctcctctacacagcgtatcatcgccccgatttcacggggtctcaagcccttccccggttctgtcgccagaccgggtgcatcgaaaaataccagtggacccgtggggatttgaaccccaggcctcggcgttgcaaacgccgcgctcttccagctgagctacgagccctctgattccattccggaacactgataactctatggtctgtctccatctgccacaactttcatttcgttaggaggtgatccagccgcagattcccctacggctaccttgttacgacttaaccccccttgcaaaacccagattcgaacatatcaatgatacatcctcatcaagacctcactcgggtggtttgacgggcggtgtgtgcaaggagcagggacatattcaccgcgctatgttgaaacgcgattactacggattccagcttcatgcgggtgagttacaacccgcaatccgaacttcggacaggtttaggagattatcctcacctctcggtgtcgaaacccattgtcctgtccattgtagcccgcgtgtagcccggataattcggggcatgctgacctaccgttgcccattccttcctcccctttagcagaggcggtccgagcagtgtccccatcaacccgaaggtcaagctggcaactgctcgcgtgggtctcgctcgttgcctgactaaacaggatgcttcacagtacgaactgacgacggccatgcacctcctctcagctagtcaagtagagtcttcatcccgactatcattcagctgtcttatccggtgagatttccggcgttgagtccgattaaaccgcaggctccacccgttgtggtgctcccccgccaattcctttaagtttcagccttgcgaccgtactccccaggcggcgcgtttcacggtttcccttcggcacctcagtgacacgtggtcactgacacacctaacgcgcatcgtttacagctgggactacccgggtatctaatccggtttgctcccccagctttcgtccctcactgtcggacccgttctggtgagatgccttcgccataggtggtcccaccgggattacaggatttcactcctaccccggcagtacctctcacctctcccggtccctagaaatacagtttcccctgaacgcccaccggttaagccggcggatttctcaagggacttgtatatccagctacggaccctttaagcccagtaatagcggccaccactcgagccgccggtattaccgcggcggctggcaccggtcttgcccggccctttcttcaccagttatttacactggtggacagccagcctgtgctggcactcggggtttccttatcacggttgcccgcatggtaaagttttcgcgcctgctgcgccccgtagggcctggattcgtgtctcagaatccatctccgggctcttgctcccacaacccgtaccgatgacaggcttgttgggccgttaccccaacaactacctaatcggccgcagactcatcctgaagcgacggatctttcgttcgcataacattccagtcagcacgaactatggagtattacccccagtttcccgggattatcctcctcttcagggcagattgtccacgtgttactgagcagtacgccgaggtcttgcacctctcgactcgcatggcttagtcaaaccccgatagcagtggcctctggcaggatcaaccagaatttctaaatttctcgcacactgtatctcttaaagtattggcagatgcagacagatatccacattaccagtattcctatgtcagaaccgatactgcaccacagtgcattcgtcgggtctccattaaaacggcctcttacgttgctcgctgaaggttatatactttcgtattgcccttcccgaacaatcattccccggccgccggctcctgatgtttcaggaagcgtgtgggatacaatagttgatcgaattcacatatatagataacgaggttctgaaggaaaatttctgtcacttcatcacattcactctatctgcgttacatcggtcaatattttccaactcggttttatgaagatattttttcggaattatacttccgatgcaggagccgggaggatctccggaggtctctattctctctagagcgcagattcagatcatacctgatccggtcgcatgctgaatcgccgcatacgtggctggattgggctcaatatatacctcgccaaaaaacgtatcctgggaaatctccaggtatccttcatgcataaggaagagcagcgggataaatacatgaacgaccggccatttcagacggtttgcaatctccgataaagtgactttcctgccctgagacacacagtccacacagcaggttaatacttccatggcattctcctggtacgcttcctcatgggcgagtgagacgacttcttcagtatacacgagcccatcataactccagacttcgcgttgtcgccttcgctcttctttttctgcattccgaagaaggttgatgagatcgtaaagggtaatcggctgtttgcacatactctttcgttccagccggcgcgtgatctcatgttcaagcagctggactggattgtgaatccgtgacagaacatcatcgtccggactctcagggatatcccccccgtcatcttcttcctcaaatccccaggagcgatctttcagataatcggatttgatccgcagaagagttgcggcatacagaagagttctcgctgaaaggcggagatcaagcataaaccgcgatgataaatatttataatcagatacagaatagaaacagtaattcagaatgattcgtacaaaagagtctctcgttgaacaatagcagcgaggatgatttcccgaggactcgcgtacctcagtaccgtcatccacgtgaggtgtcttaacttccgtgttcggaatgggaacgggtgtgacacacctgctgtggccgctattgagagccaaattccgggttcgaaccggaatggagttgacctgttgtcaaccgcgtgactgctcagccacttggcctggcttggatgtgtggaagatgcgagagataatttcaccagcgtttaaggatttcgtctgggtttgagaaacatgaattgacgttattaagacgattagtattcgcggactgaacacgtcgttgccttcgtgcgtacatcccgaacctatcaaccgggtcttttacccgtgtctttcatgaagtctcttgttcaggctgagtttcaagcttagatgctttcagcttttatctcttggcgcgtagctgcccggcgttgccttgtcagacaaccggtagaccagtggcgccgaatgaaagttcctctcgtactatttcattcttgccttcagacttccaacactccttatagatagtaaccgacctgtctcacgacggtctaaacccagctcacgatcccctttaataggcgaacaacctcacccttggctgctgctgcacagccaggatggaaagaaccgacatcgaggtagcaagccgccgggtcgatatgtgctcttgccggcgacgactctgttatccccggggtagcttttctgtagtcaatagccctcatcaacagggcgtattggttcgttagacccgagtttcctctcgcgatttcttgctatgcgaaatcgcgtcaggccaacttttgctcttgacactcttcagcgggtttctgacccgcttgagttgaccttagggcacccttgatattttttcgagggtgtggcgccccacccaaactgcctacctatcgatgtcctgataaatcagttagaattacaataaaaccaggatggtgtctcatcggtgactaaccaacccccacaagggttggatcgacgtctcccatctaccctgcgcaggtaataccgtaacccaacgacaggctgcagtaaagctccacggggtcttcacttcccataaggagtcactagtctctgcactagtacaaaaggttcaacgggtatgtgttagggacagtatcgctctcgttattccattcatgcaagtcgccaattaagcgacaaggtactacgctaccttaagagggtcatagttacccccgccgtttacgagtccttcgtccggttgaacccggtgttcagatactcgcactgggcaggaatcacagactatacgagtcctttcggagttgcagtctgctatgttgttattagacagtcggagcgatcttgtcactgcgacctgcccaatcgctgggcaggcaccccttatcccaaagttacagggctaatttgccgagttcccttaacacatttactcccgacacgccttcgccttctcagcgaggggcacctgtgtcagttctcggtacggaccgtatcacccttttcacgggctcctggaatcagcattgttaccccatcaccgttttgaaaaattctcaccattacggtactccaatttcatatccggcttagacggagcgatgactccgcaatgcctatccgaaagcgtcaggattgtttgatacaggtacaggaatattaacctgtttccctttcggcgtactcgaattacggtacgtcttaggaccgactaaccctcgactgacgaacattgtcgaggaaacctagcccctgcggcggattggattctcaccaatcttaagcttctactactgccagaattttcattcctacacggtccacaggatcttgcaaccctgcttccgcccatgcaggacgcctctctacgccatcatacaattcgtatggtccgtggtatctgtggcaggcttaagccccgtccattttcagcgccctgaatcttgactggtaagctgttacgcactttttaaagggtagctgcttctaagctcacctcccagttgtctttgacccaggactactttcagtgtttacactgagcctgcactgagggacattaaccacggtctgggttgtctcccttacgcattacaagcttaccccgtaatgcggacttccgatcgtcgctgatgacagggaatttggagtttgacaggagagtgaggaatttcttccccagcttccccaatcagtgctctacctcactgtcgatctcagatcaggtcatgctacggcatgtttcgagaggaaccagctgatgcccggctcgattaatctttcactcctatacgcaggtcacgcgaatgatttgcatatcaaaaccgcttgcggtcctccacgcacctttcggcacgcttcaacctgcccacgcatagatcgccgggcttcgggtcttatcctgctgactccacgcactggtagtacgtcgtccctgaccttacggctgcggacttgttggtttccctctggcttctttcatagaaattaaccgtcgccaacagaataaactctctggcccgttcttcaaaacgtacgatacgacaccggcaacaaaacccgtacttgagtctcgcaactcgttccttcgctttgaagatcctttcgtgccgtatcacgcgataacctgtcagtttcaggcacttttcaacacctttccagggttgcttttcagctttcgctcacgctactactacgctatcggtttcggggagtatttagttttggaggttgatgacccccacattcacgcgggaattccgacccacgctactcaggataccgctaaagtctgcatgcatacacatacgggactgtcaccctctctggtataccgttccaggcaacttcagttctgaatgcaaatcttatgccgcggtccatacaccacatctcccgaaggattcggtttgaactctgtcgtgttcgatcgcctctactaacgacatcccggttggtttcttctcctgcccctactaagatgtttcaattcggggcgttccctttccgatggcggaatgatgctttatgcatctggatgtcctattcggggatctccggttcaatgactccatgcgtctacccggagcttatcgcagcttggcacgcccttcgtcggcacccgaaccgagccatccactgacaggcgtaagaacgtctttttgtagtttcttcaaacccatgtaacgtccagaaacgcctagtgattttctctacgcatctcctctacacagcgtatcatcgccccgatttcacggggtctcaagcccttccccggttctgtcgccagaccgggtgcatcgaaaaataccagtggacccgtggggatttgaaccccaggcctcggcgttgcaaacgccgcgctcttccagctgagctacgagccctctgattccattccggaacactgataactctatggtctgtctccatctgccacaactttcatttcgttaggaggtgatccagccgcagattcccctacggctaccttgttacgacttaaccccccttgcaaaacccagattcgaacatatcaatgatacatcctcatcaagacctcactcgggtggtttgacgggcggtgtgtgcaaggagcagggacatattcaccgcgctatgttgaaacgcgattactacggattccagcttcatgcgggtgagttacaacccgcaatccgaacttcggacaggtttaggagattatcctcacctctcggtgtcgaaacccattgtcctgtccattgtagcccgcgtgtagcccggataattcggggcatgctgacctaccgttgcccattccttcctcccctttagcagaggcggtccgagcagtgtccccatcaacccgaaggtcaagctggcaactgctcgcgtgggtctcgctcgttgcctgactaaacaggatgcttcacagtacgaactgacgacggccatgcacctcctctcagctagtcaagtagagtcttcatcccgactatcattcagctgtcttatccggtgagatttccggcgttgagtccgattaaaccgcaggctccacccgttgtggtgctcccccgccaattcctttaagtttcagccttgcgaccgtactccccaggcggcgcgtttcacggtttcccttcggcacctcagtgacacgtggtcactgacacacctaacgcgcatcgtttacagctgggactacccgggtatctaatccggtttgctcccccagctttcgtccctcactgtcggacccgttctggtgagatgccttcgccataggtggtcccaccgggattacaggatttcactcctaccccggcagtacctctcacctctcccggtccctagaaatacagtttcccctgaacgcccaccggttaagccggcggatttctcaagggacttgtatatccagctacggaccctttaagcccagtaatagcggccaccactcgagccgccggtattaccgcggcggctggcaccggtcttgcccggccctttcttcaccagttatttacactggtggacagccagcctgtgctggcactcggggtttccttatcacggttgcccgcatggtaaagttttcgcgcctgctgcgccccgtagggcctggattcgtgtctcagaatccatctccgggctcttgctcccacaacccgtaccgatgacaggcttgttgggccgttaccccaacaactacctaatcggccgcagactcatcctgaagcgacggatctttcgttcgcataacattccagtcagcacgaactatggagtattacccccagtttcccgggattatcctcctcttcagggcagattgtccacgtgttactgagcagtacgccgaggtcttgcacctctcgactcgcatggcttagtcaaaccccgatagcagtggcctctggcaggatcaaccagaatttctatttttctcgcacactgtatctcttaaagtattggcagatgcagacagatatccacattaccagtattcctatgtcagaaccgatactgcaccacagtgcattcgtcgggtctccattaaaacggcctcttacgttgctcgctgaaggttatatactttcgtatcgcccttcccgaacaatcattccccggccgccgactcctgatgtttcaggaagcgtgtgggataacaaagttgtattgatccagatatataatcatcgatttgcgatccgaaatcctcgaattctgattacactctgatatccaggtgatcaggtacgatatcaaagattgcatttaatcacataaaatcatccagattctaaaaatagagtatttatgaggttttgcgcggatataacggatcatcttaatctaccaaattaaataataattcagcctgaaatatccaatatattgcatgagtttcgaaaaattatccccaaaacttttttgatcaaatttattaacaataagacaaaatttgtttaggagtttaaattatgcacgtcatggaaggatttctccccccactctgggcggctatctggtggattatttcactgccattcatcatatacgggtttgttcagctaaagaaaatcatcaatgaaaacaaggatgcactcccacttcttgggatctgtggcgcacttatcttcatcctttcagcgctcaaactcccgtcagtaaccgggagttgttcgcatcccaccggaacaggtctttctgcaatagtcttcgggcccttcatcaccaccatcatcggttttatcgtcctcctcttccagtccctctttctggcacatggtggactctcaactttgggtgcaaacacattttcaatggcaatttgtgggccctttctggggtactatgtctaccgcgctcttcgcgataccacattaaacatgtatatcacggtctttatcgccgttgcactcgcagacctattcacctatgtcatcaccgcctttgaactcacgctggccgtgccggctggagaccttggattcggaggcctgtttgcaactttccttggtgtctttgctgtaacacagattccactggcaatcctggaaggagcagtgctcgcactagtattcaagtatattgtggatattaaaccggacattattgtcagaatgaatatattttctgaagagaagatcaaagccgcacggggggagtaagaaatgaaatatcaatttgagattattgttggaataatagtaatcctgttcgtcggattgtttctttacaccgcctccatcaacccggatgcagagttcggaggttcagatggcgttggatcagcgattgtttcagaacttaccggtgttgcagaagacgatgtaacccccctgattccccagtgggcacccccatccggtgaggttgaatcaggaatatttgcacttcaggcagcatttggtgggataattctcggacttggctttggatacctgcttggacagagaaaaataaaccaaaattgaacaataaagaataatgtttgcgcatgatttcctggaagaagcagcacaacataacgcccttctccaggtacatccatataccaaacttctcctaggtattggatcaatcatccttgttttattcacatcaaattatattgtaccctgttacattgccataaccctgagtagtgtaacaattcttctcgcaaagataaacatgaggttttatttgaaactgctcggaattccgctcagttttgcattcatgagtgcactcattatcatttttctctccgaaggggtgacggaaatatggtcactccagcttttccccagattcaccctcaccgtgactgaggaaagcctcaatcatggactacatattttcgcacgggttttcgggggcatgtgcgccttgtttttcatatccctgacaacgccgatgaccgatctattcggtatcatgaaaaaactcaaagttccggacctgtttatcgacctttcaatgatcatctaccggtacatcttcatttttatggataaagccaggcagatatatctcgcacagcagatgcgtcttggatataccagacccagggaagcgttacattcctacagcatgctctttggaagcatcttcatcacatcatgggatgcaggcgaagatctcatacatgccatggattgccgttgttataatggaaaatacgcaaaaatgatcacctataatccggtggaatggcgatcactatcagcagtttctctctacctcttcatcatcatcggcatgatcctctggacatcagggtaaaggaaaaatcacatggaacccctcatagaactcaaagatctcgagtatgcctatccatatgcctcgcctgcgctctctaatatcagcctctgcattcagaggggtgagaagattgctctggtcggttccaatggagcaggaaaatcaacgcttcttcttaccctgaacgggatgatacggccggacaagggaacggtcaccatttatgggaaaccagtatcatatgatcggaattcacttcggaagatacgacagaagatcggatttgtctttcaggatcctgatgtccagataatagcacctaccgtatggcaggatgttgcattcggaccggtgaaccttgattattcggaagaacaggtacagcaggcggtttcgaatgcgcttcacagcgtcggactggaaggatttgagaagcgtccaccatatcacctctctggcggagagaagaagagggtggccatcgccggtattctggccatggatcctgatgtcctcatcctcgatgaacccacgagcatgcttgatcctgccgggagcgaagatatcatggacctccttgatgaactcaatcaccagggaaaaaccatcatcatctccacccatgatgttgaacttgcctacccctgggcggatcgaataatcctgatggagaaggggaggataattgcatcaggtacaccggaagaggcgttctcagataaagaactggtcagacgcgcacgactgaaaacccccatacttcttgagctctcgcaggaactgaagagcaggggaatgaaaacaccggggacattacccagaaccgtccttgatatcatcaggattattgagcataatcaccatggatccatccgcctctctgacaatggctatgggacaatacatgtcggggatgttgatctgatatccggatcacacatacaggcgattcttgccagaacttcatgtgataccatcggcgtgatggggagcagggcaaaaatttgtgcccgtcagtggggtctgattccggacatctcctatgcggtcattgataaatgcatccttcaggcaatgaacggacggacaagtctgattctgacaaccggagggatggtgaccagagtctttgaacgggtgagcatgtttaatcagacaaacaaccggtcaattcccgttcgatcactcataggggacgagataccagatgatttgtcaggtatctgatcgtttagacacattcaaaaccaatcacttttgaagggcacccgctaatgtatacggagcatatgatacattgtccactggataaaccaccaacaggcggaccaacaaaagatgaagtactcgcaatagcaatgcataagctggatctgaaaccggcagatatttttgctgatatcgggtgtggaaccgggaaggtcaccctgaccgctgcacctctggtttctcatgtccatgccatggatatcagagaggaagcataccggtggacctgtgaggaactgcggaagagtggttttgccaatgtaacgccgcactttggcaatgccgtttctattctttcctctctggataacatagacaaagccttcgttggtggatcgaagaatctttcagatatcatcacccagctggctcaccttacagtgaagaccattgttataactgcggttctccttgaaacgctcaatattgcaatatcaacattacaggaatatgatatgtttcatgaagtcacccttgttcaggtttcgaaaagcatgccgcttgccgggggatttatgctaaaaccccttgatccggtttttatcatcaccggaggatgttcttaaatgctttccggagtggggcttggtccaggagatcctgagcttctcaccatcaaagcggttcgcatgctacaggaagcggatgtcgtgtatattccaggtggtctggccaggcggctggttgagccgtactgcacccccattgaacttcccttccccatgagtcatgatgaggagatgattcgggcgcagattatcgagaatgctgaaaaaatcgcatctgatgcgagggataaaaatgttgtctttggaatcatcggtgatccgaatatcttctcaaccttctcgcgtctcactgtgattttgaaggaacgataccccaatatcatcatcggtacagttcccgggatatcatccataacagcactcatgtctgagaccggccttcccattaccgggggcttttgtgtaaccgacgggagtaagattcgatcccagattaggatgaaagtaagaaaaccccgtgagttggcagagaatctccgaaaagaaggatactcgagatttgtactggtagagcggatgtacatggacggtatgcaagtgcttaacggggatgatcttccggaagagagcagttacttctcactcctatatgcagagcgtgatctatgaataaaatctggtttattggtgctggacccggagatcctgatctcattaccgtaaggggacgaagactccttgattgtgctgacatactgatatatgccggatcattagtcaaccctgaacttgttgcaagctctccggccagcgaaaagtacgatagcaatggcatgagccttgaagagatgatccccatcatggtcaaaggaatccgtgagggaaagaccgtggtcagacttcattctggagatcctgcactctatggggctatcgtggagcagatctatctactgaaacaggagggtatatcagtcgaagtagtccccggtgtctcctcgctctttggtgctgcagcggcattgcaggcccagctgactctccggggagtatctgaatcggtcatcatcacccgtccggccgggaagacacttgagaaagataagatattcgaactctcagagaccggtgagaccatggctatctttctggggactgacaaacttgaggagataacctcccgccttgcctgtcaccccgagaccactgcagtagtagtgtaccacgcaacatggccggatcagaagatcatcaggggaacggtacaggacatcgccaaaaaagcagcagatgcagggattacaaaatccgcccttctgctcatcggtgatgtctttgccgaggatccaaaggggcatatcaggtcattcctttactcatgaatacggttgtaacagcactcccctactttcaggaacgggctgaaagagtcgcatcggcaatcaacgcggagtttatccactaccattcaggattattctccgaactctataggacaacacaacggattgttgcgatcatggctatcggcatcgttatccgcaatatcgcccccctgatccatgacaaatggactgatccagctgttgttgtcatcagtccggacatgcagtatgcaataccggttctcggaggccatcatggtgcaaatgatctcgtttacctgctgcaggagagatgcggtcttacaccggtcatcaccaccgccacagaagctaccggacgggaggctgtcgaggttctggcaaatagagagcaccttcggattgtcaatacccggtctaccaggcaggcaaatgcatctgtcctgaccgggagtgccaaagtataccggttgcccggtcccgggatggttatcgccggatccggcgtctcattccttgttgctgacgggccatattcggttggtatcggatgcagactggggacttctgcagatgagattgttcatgcaattcattccgcttgtgaaacggctggtatcagtcaggaagatattgccatctatgcaaccggaggtatcaaaacccatgaatcaggccttcttgatgcggtcagaactctggggcgcaatatcatatttcttaatcactccgacctgagtgaggtggcccccccttcacagtctgctgcgtcacggttcggattgccgggtgttgcagagcccgcagcacttgctgtatcagtccatcaccacctcatcctggagaaacagatctatggaaatgtcaccatcgctatcgcagaataacccaaacactcccaccggctcactcgctgtcgtcgggataggcccaggcagtccggatatgctgactatcgcagctgaaaaagcaataaagaacgcggatatcgtcatcgggaatgacttttacatcaaccagattccgcatcttcttacgaaacagaaggtcatcaaaagtcagatgggcaaagagatcgaccgcgcaaagcaggcaattaccctggcacacacgagccatgtcgtcatggtatccggcggcgacccgggcgtctatggaatggccggacttatcctggagatggccgaacgaattgcgccggatctgaagatagacatcatccccggagtgacggcagcaagtgccggtgctgctctgcttggggcacccctcaccaatgactttgcagtcatcagtctttcagatcttctgacaccacgtgatgtcattgaaaagcgcatcagggcattatgcacggtcgggatccccattgtgctctataatccaaagagccgcacacgaacaaatctgtttgaagatgtcatagacatcgcacgcgaacacctcgctggtgaaaccccggtcgggattgtgaaagatgcctaccgtccggatgagacgatcatcgttaccacccttacagatgtcatggacgtttttgatagtatagacatgcacaccgtcgtttttattggcggtgaagagacacgaatgctcaggagatatgcagatgccagaggaatgttcaccccccgcgggtaccaccggaaatatgagttctaattatacagatatcggggcagatacgccggaggggtatgccatttcgcgaacatcacgggagctggccagaaagaccatcggagatgcaggaccccttgaccggattcgccagcgctgctcaatcgcagtcggtgacttcgcaatggcagacctgatgaggtttcagggtgatccggtacgtgccggcctgaacgctctgcaagagggagcgccgatatatacagatatcaggatggtgcagaccgggattcaaaagaaaggacacaaaagtcaggtgtcctgtatccttgataccctttcgtcaccagataccggtggaaaaacacgcacatccgcagcactgatgtcacttggagaacatttgtccggatccatcgttgtgattggaaatgccccgtcagcacttctggttctctgtgatctgattcaaaaagggatcaaacctgctcttgttatcggaacgccggttgggtttgtaaacgccgctgagtcgaaagaactccttcggacgctggacattccctcaatctcaaacgaagggacacgcgggggcactccggtcgctgttgccgccatgaatgagatcatcaccatgttcgtcgaagtgtccggaaccgtcgggtaatatgcaggatccggtcagcggatttatctacccggaggagtggatctctctctgtacagacgagacagagcgtcttcttgtcagtcaggggcttgctgtcctgacttcagatggaaccatacgaaggcgtgggtttaccaccggtagttctgcatctgctgcagccaaggcatcggtgctctcccttacaaaaaccggattcgatgaggtatcaatcctcactccagccgggatacgtgttcagatcccggtcacaattgccaggggaactggagagtgcaggaaatattccggggactatccgggagacgtcactgcaggactggtctttacagcagaagcaactcccgcagattcaggaaccacccttgtctttggtgagggaatcgggagatggagtcgtgataccccccggtataaaaccggagatccggcggtctcctgccaggccatggatgagatcaaaaacgcaattgaggaggctgtccaggagaccgggattccgggtgtatcagtcaggattttcgcacgggagggacgaatagttgcagaaaaaaccctgaaccagatggtcggagtcgttggtggtatatccgtgctggggacaaccggatttgttgagccctgggatgatcatctggaacagaccgtctgtgatcgggcggttcatgcagaacgggtcgtacttaccaccggcagaattggcatgcgatatgcccggatgttattccctgaccatgaagtcatccttgccgggtccaggcttggtactatcatcccccatcttaccggtgaagtgatcatctgtggtctcccggctcttgtattaaaatatataaatccggtaattctcgagggaaccggtttttcaaccgttgaagagttcatgaccaacgaccgctttttgccggccatgcagacatcttttcagatctataaaagcgcacacccgaatgttcgaattgtcgtggtaaaccgggaaggagcaatcatcggagattctcaatgaagattgttggtgtcggatgcggacctgggatgctgaccaggaaagcaatacaggcaatacaatctgcacaccttatcgttggatcagaacgggcacttgatctggtcagggatgtccttccatctcatgcagagatcagagagattgacgattacaagatactccggacactgcccgaacacgcagtcatactctctaccggggatccgatgatatcagggcttgggtatctgggcggagaggtaatccccggaatatcgtccgtccagctgggggcagcaaaaacaggcgtgaccctgacaaatctctttctcattactgcccatggcagggatcatgatcaggcagtgaatgattgttgtgaaatgataagcgcgaaaagaaaagtgtgtatcatagccgaccctgctttcccgatcagtgcattaggacagaaactgactgaagttaacccggaagcagagatcatcatctgtgaaaacctgggatacccggatgagcgtataacaaaaggaacggccaaaaaccctcctgcagttcagggaggaatgttcattctgtttataacagtatcatgaaaaaaccatgaaattgctgtaaataaattatataaggaaaaggggattggtctctgctcccttggggcagtcaaccagtgatatcgggtatcacagagaccaatggggtcttcatcgaacattctcctcctacaagatcctcatgaattgatacacacatttgatggggggtgtgaaatgaggcatttcacatgtatgcgtcaggtgttattcggatggggggtgtctcatgcaggttctcttgcagagaggtaattatagattatcgctgagatatattaaatttagccctcatgatcaaagatattgaagttttagttttaattttgaattattttattaggcaaccggttttagaattaaattactttttattgaacataaaaaaacaaattttaaaatatatcacatgcctataagcatatgtgaaaactactacccgtgtcaaaaagatcaacgggcatgaatacctgtatgaaataacctattactacgacaaggagacccggagaaccaggcagaaaagcagatacctgggaaaaaatgtcgatggggaacctgtcagggtcagggaaaaagcaaaaaatcctgaacgtgtgtactcatatggagagtttatcccctaccttcaggcggtaaaaagccttcatatccaggagattctaggagcacatctgactgaccatgaagtgaggctctttctcacccttctttatgccggcattcatcaccctgatgccctccactcacccgcctcatggtatgacgggacggtcctcccccgaatcttttcaggccttaaaattaccactcagagtatctcccggctgcttaaaaaactgggtgaaggctccattcatcttagtatctgccgctcattatctcagattcctgaaagcgggaatatgcgaatcagcacaatagacatccccatggtccagcagacctcatggcatacaggaatctcccaccacggaatggaaccgattgctctgttttatgataatatcgccaatatcccggtaggatatctttcttcagcccaatatcttatcacatcagacctggtaaaagcgatcaatgcaggaatgcacctattctctgggaaaaagggggtcatcatatcaggaaagagttttgcatcatcaatgaacctgtatggagcactatacagtgaaatcccggtcatcttcccccttgatcctgaccatgatctcattaaagaagagattaaaaaataccggactgacctgatgcatccaaaaaatctcaagatcttccggggtgaaaccctgtttgttatcccatttaatatctccctcgaaacagttcagataaaggggtacatcatctacagtccacgaaaagaagaagagatacgggaacgcttcggggaagatattgaactcattcttgaaaatctgaatgataaaccgatttacaaatgggtcaatcccgccgaggcagttgctgatgttgccggtatgtatgaacccttcctccagtggcgtgtccagaataaccggattctggtggatgtcaagagaaaggctctgggaaaatatttaaaaaactgcggaatttctgtgattattaccggagatccagaataccagtgggacacctgccttgagtggctggaagagcgtgccgaagcagagaggttcctttcaacttatatcagaaatttccaggtcttccccctctcagttgatagtgacacgatgagaagcggtgcattcctcgtcgcattcctggctcatgtggtgaaccggtgggtgcttgaacaatatgcaaagtcaggacttctcgcaatttacactgctgaaaaaatttatcttgaactcatgaagatacgcctgataggccttggtaatgaccgggttttagtaacagggctaaattcacggcaaaaagagattcttgatacattaaagtggaacacagagatataatctgacagtcacatcctaaataggcaatatttttctcaggtgcattccaaattgaacttttaggcaggccacccctccaggtgcataaacgaattatggagtccggctttcattgtcaggaaagcggatcagaactccatccctcatcaaaaggccttcatctaccatctgcccgaggatcctagttgtccgctcctcctcactctgaatcttctgagagatgaggtcacccaatacagggccctcagccaacaatactttcaggatcctgcccctgatctcccgatcactcccggagaactttgattgcaccgcataatgcctgctccgacggttcggattttctatagctcccgcaagaaatgtcccatagtccatgatgctgtaataccattcccggggatgattgtggtcaagggtccaggtaagcaccggatatatctccatatcagatacccccacccggtcctgaaaaaaatggtgaataaatacccggcgtacatttgtttcaatgaatactaccgggcggtcataaatgaacacaacgattgatcctgctgttgctgcgcctatgccagggagagtctgtaatacggcaggatcttcagggacaattccgtcccaccggtttattatcacctgcgcaatctgaagaaggtattttgcccgccgattataaccaagaccctgccatgcccgtaggacatcctcaagtgatgcctgtgcaagagccgcaaaatcagggaatatcctgataaactcatcaaactttttcaggacgcgggggacctgggtctgctgcagcatgatctcggatacaacgacccggtacggtgtgatctcatccctccagggcatggggcgccggttcttcacataaaactctgaaagcattgcattgaaccggtctattgatgcaggatcagcagagtcaaaaaattcgtccataaaatcagtcaaccagaatcccaaatattggttatattctccccgtcttcatgatgtagcattcacttatatctcctcacccatagaacaatcagacaataaaagtgcaaggacgatggattatatacggaaatcagtctggatctcacggtatacgaatctacttattcacagaaaccatttgtatattcgaataattttagaggctgttgcataaccaaaatgtcatttccgcaagaggacaatttccattcgattggaacttaaatcgtcgaaaaaaaatctggttttttcctcattgtactaactgtttgaagttatgcaacagtctctttatgaaatctgaaatttctgaatatctaaaagaaatcacccctgatattatcagttcgaattctgaccctaccttggtaaaccgtttactcggtattatcgaagaactgcaggatgaagtgaagcgtctgaaaagaactcagggttttgatgttgtcaggggcaagagactaaagccgctgaactatattgccggaaaagataagatatagatactattgaccagtatccagtgaaattactgagtataaggcacgatctgctcacctggttctgatcctccagagtttttttttatccagggaggggattgccttcacctgattctttttttcatatcgcttcaatgaatcatgttgcttgagatatttttagtgatgagattctgaaactctctaaacaatctttgttttgaagagatctcttatttgttgcatgaaagaagaaattataatgtatagaaaaattgctgaaatcggtgagaactacatcagtatttattgcttacaaaatactacttctatcaaggatgagcgatcaggcagtgcatgtacctcacaagtcagaatggattaccatttctactgatgagtatgaatccatgcagcgcacaatagaggttctttcggaccccgacttaatgactcagcttggagaggggaagagaaagaatgccccaatgaaggattttgaggaactggccagagaattgggaatttaaaactcatctttgtgtttgatagcttcaataattacctcacccttttcaatgtcaatggtatagagaatccgaaattttcgttcaaaatagacctcccataatccgtggagtgaacctctcaatggttttccgtggatatcaggataatttgatagtttcctaatcttctggacgaatcggtttgaatttctttatcataaccctttaatctatcttctgcgggtttcctgatgacgattcggtaagaattcacaattattatacacggtaagagaataaataatcacaatctcattcgttcagtgtttagggtaaaaatagaagatttataaattatcttcaaatcttaagcccctgcagggatctgacatcaattattttcttctctggagatgactattcccctgacagatgaccagcccagggtacctcaccatctcccgtgaccttctcatttcccggatacgtgctattcaggaacgttcttcaccatgtgtcctttgtccccgccattgcagagccaaacgcaaaacaggagaacttggattttgcaggaccggtatccatccccatgttgcctcattcggtccgcatttcggcgaagaacagccaatatcaggaacctgtggatcagggaccatcttttttaccggatgcaccatgggatgcaggttctgccagaactatgagatcagccatgagcggatggggagagaactcacaaagcaggatcttgcatacatctatctccatcttcaggcactaggatgtcataatatcaacctggtcaccccgactcaccagctcccggctatccttgaagcacttctgatcgcaatggatgccgggcttcagatcccacttgtctacaacacgggcggatatgaagacattgacacactcaggcttctggaaggaatcatcgatatctatatgccggatttcaaatttgccgacgtaaagacgggaagaatactggcacatacacctgattacccacagatttgtaaggcagccctgtgtgagatgcatcgtcaggtcggtgaccttacccttgagaacggaattgcaacacacgggcttcttatccgtcaccttctcctccccggacgcggtgaagaatcagagagaattatccggttcattgccgaacagatctccccgaatacatggcttaatatcatggaccagtacaggccggcaggagatatcaggagattctgttcaaacgagtattctgatcttctccgtcgggtatcagacgaagaagtggccagggcaatcaggattgcacaagagtgtggccttaccaggggccttgaggaagagaattatacaccaggatcatgagtacagatcgagcgtcctatctacccatccatccagcctgaacttccgccggagtccggcctcattcatataccggatggttccaaataccggccgctccttccatggtcggtcatgtttgccaaaacaccaggcaaccccgcagtatccgttcgggtcacgcccgtccagttcataccggttattgagataaagcgcaatagcatatgcatcttcaggtgtttcagtccattcaaggatcttctttccccagtacatccgcaggtatccatgcaggtacccggttcgaatcatcgagagttgcattgcattccatgctctatcgtgagtcctgcactcttcaaaatctgccggcgtgtatgaatattcccgtgtatcaattcgatgcttctcaagcgacttccttgtccactccgggaggccttcatagtggtcatataaggggttataccagacaaaattgtgtgataactcccgacgaacgatgagttgttccagaaacgcatttgttcccggtccgggatgttccatcacccggagggcgatatcaagcggcgatatatgaccgaaatgcaagtatgcgctcaaatatgatgttgcatgggctgtcggatcattatgagtggcctcgtaccggtcgatggtctcggagagaaatgcagagagataatggtctgcagcattctctcctccgggaaggaactgagtagaagtatcctctgggagaggtttccctgtaaactgctgctctgctccgactgggagccctgtgaatggttcacagtccgtcgattctccctgcacatgccgacagatgagggggtgcagaaaggcaggaagttgccgggtaatctttggtctgaatgttcctgccgaccattcttcctttggtgaagcaacatgaaccggtacaatcaggttggtctcgacaattactaccttacagggagcggtatcaatgactttttgcctccactcccgctgaagacgggtccagccctgatcggtcaccatcatgcatgcatcgtctgcaatccggggaatgatatcaaccggactcccggagaggatttgaaatccgattccccgctcggtaagagaacgattcacatcctgaagaccctcccataaaaaccggtaatgaactggtgttgcctcaggataggagtggtcaagacagaagacgacgatgagaggttttttcagttcgttcgatctttcgatcgcatattcaagggcatggttatacctggtcctgactgcggattgcatccagtagaggatgtacgaacccttcggttcctgattattgaatgaagtaatgcgttcaggctggatcataagtaacaccgaaggccacagtttttttatccggaaatattacatgctcttagtaatcacaaatatgtaagttcatcatgagatgaggacttatgacttgtgcatacacgggaattataaaaaaatcgggagatttttatattggtctttgtcttgaactcaatgttgcaagtcagggagataatattgaggaggcaaccaggatgcttcaggaagcatgccaggagtacctttcttttgttaaagaagaaggaatcgaagatgagattaagccagtctcgttggacctgctcagagaatttcttattggagacgatggatcctctacctcaaatgatcatctgttttctaaaaaaataacaatctccggtccctgtgccgcataaaatacccccggtgccaagcaggaaatttgtggccctcctggctaagggcatgcacggttaattcgtcagcgtggaacgattcacacaataatttgagagaatatccggggggataacatatcatgcaccggtggttatggcaaaagatgagttatcttcccattatatgctcattgttctccggcaactgggattcaccgatgatgatattgaaaatctatttgaataatagggaaaaataaaaatattgcaataatattttcccacaacgcttattgttatgcgacatcactttgtctctattgagaaatttttcataatattgcttattatttgctgactcatattcagaagctcaataccaacaattctgttatcttcatcataatcgaggattactcctggttgaatctcttcagaatccataatcgctgattcatgaaatctcagataaagggcctcatttgcagaatctattgtaattttcatttttgtaccctccgatcaaagaacactgtgataattctctgcggttgaacagatgggttgataattacccgtaaaaacttccccttcctctctggtattgcggaaatataatgcatcgtcccatcttctctcaattcagtataatcaggattttcaattgtttttcgaatccactcatgagaaatatcacgttcttgcgccatagacaaagcatgcagagaaaaacaataatttgacataaattattgcatcaatatttgctatctatcatttattgagattgcatttcatgaataattctgcgaactatatccttttaaacatttttcctaattcctgacacgagaacgaaattatcgtcggccggccatgtggacaggtccagggatcggcagtctgtgacagttgatttattatatccatcccctgttcaggggtgagcaccgctcctgctttgaccgcacttctgcatgcaaccagccggagaacctgttcttttaaccgaaccggcccctcgtcttctgagaggatcgttccgattatctccctgaccgtttctggatcttcatatcttccgaggaccaccgggacaccccgtacacaccaggtatcctgaccaaagggctctataataaacccttcatcggtgagaaccggaagaacagacgggataagcccggcttcggaggggctgagggtgagcactaccggggcaatcagttcctgggttttcaggtgcaaagactcctgctgctttaactgatcatatctgacccgttcatgggctgcatgctgatcgatgagaaataatgccccagtcttatcgcttgcaacaatatatgtcccgccgacctgcccaatccagaagagctcggggaaccgttcatccctgaccgtagcatcatcggcactctcctgtaaccgtgtctgcaaaagctgacgtgacgtggtccggtacccggaaagagttgcttcacacacctgcctcgaaaccggagccgctgcgacagctccataccggattggagctggtgccggagaaggaatatcactgagagagatctgtgcatcttcatccgctgcggcagggagatcaagcagatttgcatcatcaagagccagtctgacagtccggacaagcagatcaaggattgttcgttctgcagaaaatctgacctcacgcttggtcggatggatatttgcatccacttctgccggagggatttcaagcatcaggaccgcaaccggccatacattgccgggtatcagggatccatacgcccgttttaccgcagagaccatcgcaggagactgaacaagacgaccgttcacggcaataagtaaccgttgtctgttctgctttaccagtttcggtagggagataagaccggtcacgagagtattgccatccctaccgcggattgggatcatcatccctgcatcagacggatagagtgcccggaagatatcagaaaggtcagaccccccatgagttgagaatttttcaatcccgtttacgaggtaccggaaggtgatacccggatacagacatgcaaatgactcaagaagggatgtgatgtgtgcaacctctgtctgcaggcttttcaggaacttgcgcctggccggtgtattgaaaaacacctcttcaacggttatcgaggtcccgttcggtgcccctgtctcggtgcattcgacgacctctccccccgtgatccgaaacaggattgctgtatcagactctttcggctttgttatcatcgtcacataggagactgccgctatgcttgcaagtgcctcaccccgaaacccaagcgtccggcaggaaagcagatcctcaccggtcctgatcttgctcgtggcatgggcaagaaaggcaatcctgacctgatcagaagggattccgaccccgtcatcggtgatccggatgcgggatatcacgccatgagctgtagagagttccaccgtaattctggatgaagctgcatcgattgcattctcgaccagctctttgacgatggaaaccggacgatccaccacttctccggcagcgatcagatggacggttgattcatcaaggacctggatgaccggggcaaggttggtcatggatgtcgtgccttctcctgcagatcggcaaggatactaagtgcctgtattggtgtaatctcattgacctgaagtgagcggagttcttcccgcagaggatccggcccggcctccctgaccggctctgtcccggcatcaagaagaatcatctgggtgtaccgcttgacaccaccgcccatcggatcctccccgctcataatccgtttcatcagctcttcagacctgctcaccaccgaagccggaacaccggcaagctgggccacatgaataccataactccggtcggttgcgccgggcaccagtttccggaggaatatgacgtccttgtccgtctcctttaccgcgaaatgacagttacggacccgtttaaggtcggcttctatcccgactatctcatggaaatgggtcgcaaaaagacatcgcggccccttggacctctttccatgaaggtgctcaaggacagcttttgcgatacagtacccgtcaagcgtgctggtccctctgccgatctcatccaatatgacaaggcttttctctgtagcatggttgagaatggttgcaagctccatcatctcaaccataaaggtactctgtccggaggcaagatcatcaaatgccccgaccctggtaaatatccgatcaacgaccccgatcctggcatacgtagccgggacaaaacttcccatctgggcaagaatgatgatcagggccacgctccgcatataggttgactttccggccatattggccccggtgatgatcaggatctggtccgatcctgccgagagctcagcatcgttcggaacaaaacccccgccaatactgctctccaccaccggatgacggcattcacggatcagaagggttggttcatcgacaagttcgggcctgacatactggtttttgagtgctacttcggcaagtcctgcatagaggtcaatcttcccgatcgcctgggctatctcctgaagagcaggtacctcctgacttgccttttcgatgatatccctgaaaatctcctcttcaagactctgcagccgctcgtcagccgttgctatctgggactccatctcgcgaagtgccgggacggtataccgctccccgtttgcagttgtctggcggcgttcataatcatccggaacactggcaagatttgccttggttatctcgatgtagtacccgaatactgcgttatattttattttcagggattttatcccggttcgttccttctcctgctgctcaaggtctgcgatccattgtttcccgtttcgtgagatagtccggaggtgatcaagttcctcatgatacccgtcctgtatcaccccccctttcctgataagggctggtggatcctggacaattgctcttgtgataagatcggccagaggggtgatgtccctgataccggcgattgcaccggatagttcgtcaggaataccatcctctgtagagaagagggttttgagacgcttcaccgcatcattcgctgcagcaagggttaccagatcccgggggcttgcattcccataactgatcctcccggcaatccgctcaagatccgggaaccggtggatgcgggtccggacatcatgtctgacagctgaccgatcaatgaagtatgataccgcatcaagccggcggtttattacgttcggatccaggaggggtgcagcaatccttttgcggaggagacggcggcccatcggggtcagggtcagatcgatggttgcaacaagggttccttcttcggtccggtcccggatattctgcagcacctccagatttcgtaaggtgacggcatcaaggaccagatgtgatccgatatccgaccggtggaccgacctgatatgggataatgaatcaaactgggtcttctgggcataggccagggcagctcctgccgcgatggttcctgccacataaccggcacagggcagatcctcaggatttgaaatggtgaactgccggcagagaacctcctctgcagatgccttcgcgaacaaagaggaatcctgggatgatacaagcgggacgatactctgtaagaatctgaccagatcctcaccggcccctgcagggatgatgcattccgacggatgataccgtgctgcttcagaacggataccatcctgcatatcctgtgaggggatctcggtaaactgaaaatctccggttgagatatcaataaaagagagaccgacccgcttctttttctgatcaggatacaccgccatcaggtatcgtgcctgttcggttgagagaagagcggcatcgatgacggtccccggtgtgacaactctgacgactgcccttttgactatcccttttgcctttttcggatcctcgacctgttcacagatagcgactttatatcccttactgatcatgcgggacaggtaggtatccactgcatggtacggtactcctgcaagcggaatgtcctgaccgtccggcatcctgccccgtgaggtcagggtgatatcaagttctctggcacaaatctgggcgtcctcacagaatgtctcgtaaaaatcacccattcgaaagaagatgacacagtccgggtactgctgtttcgcatcgtaaaattgttgcatcgccggcgttattttccccggtttttctgcaattcccttttgcccggtttctttcggggctgccggatcactcatgactggtacacattaggaaagaaaggccaaaatggtaacctcatcacatcagaatctatgcccgtttcaggatgatttaagaatcaaacgcgtttctgcaggaataatgatagtattaaaccttaaaaaatgagaaactcttctatgaaagctgcaatcatcggcgcttccggatacaccggtggcgaactgatccgactgatgcaatcacaccctcatgtgaccattgatgtcgcaacatcccggcagctggcaggaaaaccggtgacaagccagcatccccatcttaagggattttgtaaccttacctttgaaaatccggagatttcatcccttgatacggatatcgcattcctggcagtcccccataccgctgccatggcatatgttccggatctgatggagcggggaataaaaataattgacctctctgcagattaccggctcccacaagcagtctttgaggaggtgtacgggacaccccataccgcatggaaggaagtaccgtacgggctatgtgaattacaccgggatgcctgcagaaatgcaccctttgtctcaaaccccggatgcttcccgaccggggcaaccctggcatcagctcccctggcaaagaaggcacataccatcatctatgactcaaaaacaggggtttccggtgccggtgacagtccgtcagcaacaacccacttccccaatgtcggggataacctgacggcatataaatggaccagccaccgtcaccttgctgagatgagacaggagctggcatacctcggatcaccggcccggtgctacttcacccctcatctccttccggtgaaccggggcatcctgaccaccgcccatatcctgcttgatgaaccgatcgaacagaaagaagtggagaagatataccaggacttttaccggaatgaaccatttgtcaggtaccagcggccttcactcaatgctgtccggggatccaacttctgcgatctgatggtcgaagcatcagagaaccgggttgtcgcggtttcggtgattgataacctggtgaaaggagcgagtggccaggcaatacagaatatgaacctgatgtgcggatgggacgagacactcgggcttatgaacccgggaatgcttccctgatggagaaaatatgcttgttcgcgatgcaatgaccaaaaatccggtgacctgtaacgcaggcgactcaatcgccgatgttgccggagtaatgcgcagcagaaagattggtggaatccctatcctggagggagatgtacttgtcggtatcgtcaccgagacagatatcatacaactcctcatgacaaaagggccctctgatgatctctggctcccgtcacctcttgagatcatcgaactgccggtcagggaatttatcaactgggaacatacgaaaaaggctctgaccgatatcaggcagaagaagataacagatatcatgagtaaaccggtgatcaccatctcccctgatgatgacatcgagaccgcagcacagcggatgcttgagaagaagatcgatcggctttgtgttaccgaacaaaacaaactgatcggaataatcacccgtgaggatattgtctggtccctggctggtgagaaggatgcataagatgcagtcgatttgtgcaatagaaggggtaaaagcagcgggaatcaaggaaggcaagttcggccttgcacttattgaggcagaaggaaccgccgcagctgcatttaccatgaataaggcgtgcgcagcccccatcatcctcatgcgtgagcggatgaagaagggatacctgaccgccaccataacaaatagcggatgtgcgaacgccctgaccggaaagcagggaatatcagatgccatggagatggcagcaatcgccggtgagtatctgggtgttgaaccagagaccgtcggtgttgcgagtaccggggttatcagccggtacctgaaccttcccctaatccgggaccagtgttcccgtattgctccgatgatgtctcacgggcctgatgcggagatagcggctgcacgggccatcatgaccactgaccttattgaaaaacacgcccttgtggaacgcgacggatttgtcatcggaggtatatgtaaaggatcgggtatgatcgcccccaatatggggaccatgctcggatatgtatacaccgatgcagagatcaaccagcaggatctgcaggacgccctgaaatctgcggtcagacggagttttaaccgggtcgtcgtcgacggtgataccagcaccaatgatgtggtattctgtaccgctaccggagcagcaggaaaggtctcaaagggtgagtttgccaaagcgctggaggagtgctgcaccatccttgggaagcatatcgcaaaagacggagagggagcgaccaagatgatcgaggtggttgtcaggaatgcccaaacagaggatgatgcagatctcatcgcacggaccattgtcggatctcccctggtcaagacggcggtatacggggaggatccaaactgggggcgtatcgttgccgcagccgggcgttctggtgcagagatagatcccgagatcgtctcatgctggatatcaaaccggaagatccgggcgcaggtatgtgaccgggggaccatatcggccgatctctcccaggcgaaagcagccctctccgggagtgaggtcaggattgaactggatcttgctctcgggaacgagcatgcaaccgcctggggttgcgacctgactgaaaaatatgttgagattaacgggaagtacaccacatgaagcgtgaagacgtcctgatggaggcactgccctacatccagaagttccatggaagaagcatggtcatcaagctgggcgggcatgccatggttgatacctgcattatggacaccgtcatccgtgatgttgtcctcctccagctggtagggattaaatgcgtaatcgttcacggcggaggtcctgagatcaccgagaagatgaaggccatggggaaacagccacgatttgtatctggccttcggatcaccgatgatgacacccttgaagttgcccagatggtccttgtcggcaagataaattcaaagatcgtctcccttgtctcccgtgccgggggaagggcggttgggatctccgggaatgacgccaaccttattatcgcgagaaagatggaccggcaaaaggtcagggttgaaaaccgggaggaggaggttgaccttggacatgttggagagatagaagagattcggccggctctccttcacacgctccttgacaaccagttcatcccggtcatctcaccccttgccatcgaccggaatggcaatgatctgaacatcaatgcagataccgcagccggagagcttgccatcgctcttggtgcacacaaacttatcagcatgacagatgtggacggtatcatgaaccgtgaacggaccgaggtctaccggcggatgacaccgcaggatgcagaggaactgatcgcatctggcgtcgtgtccgaaggaatgatccctaaagtgcttgcggttcttcgtgccctccatggtggtgttccctatgcccatatcatcaatggtaacctggctcacaatctgatcatggaactcttcaccgctgaaggggtcggaaccatgatcaccgaccgaattgacgaggtgtgaaggctacgacgacacatcagacgtattttcgtgcctgcattctgatcctgatgctactgggatctctgaccggcccggtctgtggctcggtatatctcaggaacgggacagagataagcgaggatacagcctatctcaccattctgcaggatggaaataccaccgcagaaaacctctccatccagtttttctacaatacccattgtggtgcatgccacagtgccctggcgtttcttgagaaataccggtctgaaaaccctgggatcgtaattgcataccatgacctgtttaatagtaccgaaaacagggaactgtttgagaattataaagcacagtataaccggcagtatgcagcggtcccggtcatcttcatgggaaatgccgtgcttgaaggaacttatgccatcgaggaaaattttgaaccgctggtgaagggatatgcagaactgaatacgaaaggattttctctcccctcactcccgcaattaactctgtcgtcacaatcaaaatcagacggaacgggtatcagcatccccctgattgtcggagccggacttctcgacgggatcaatccctgtgcctttgcagtccttgtcatcctcctgatttacctgatgagtcttggcagcagacaaaagatgatcctggcaggaattgtctactcagcggcggtcttcttcttctacttcctctccggagtagggattttcacggcaattcaaacaaccgggatggtcaaaggattttccttcgtggcagcgatgattgccatcattgcagggattttgatgataaaggatgccttttatccggggaagggtccatcacttgcaattcctgagggaagaaaaggagttataagccggtatattgaaaagtcaaccgtcccgtcagcatttgtccttggaattctggtcgggatgtttgaacttccctgcaccggagggatataccttgccattctgtctatgatatctctccggactgatgtgagtggaggccttggatacctgcttatctacaactttgcattcatccttccgcttctcatcatcattgccctggttgcctggggcctgcctccggagcgggtgaatgagttcaggttagagcagaggagagttatccggataatcatcggatgtatcatgttcttctttgcagccatcatcctgatggagttattctaaattattcctcctttttctttcgccattgctcctgaaactcctcgctcatcctcaccagtatctgaaatatatcccggatgggtgccgggtcaagaccaagattggtggattcgattgttgcccggtcaaggactgcattggcctgatcagggatccggaccgggagaccctgtctttctttttccctggcaatctcctctacaatactcattcgttctgctatcagggtgataattgcacgatctttttcttcgatagataaacggagtgtatctagtgacatgtctgtacatcatatgttttgatacctatagtgcgttgctgaacgtcttggaataatcaaaataaagaagattattccaaggcgtgcactcaaaatgcacttcatagtttaagcgaatttttctaaattattttagaaagattcgcattatactataataggagaaccagatggctgccatgagagatagaataagattttttgtaaagtcttcccctccggagactctcatcctttattggatcagactaaacatgtgtgaagatgaatttcacagtgaaaacaatcctgtatggcattcttgtctggctggtcccctttatcatcgcaattcccttctattcacctgatggaacactcctgattgatgtgcattttttcaagacgatcatgatcgtcaccggaggggccattggtgcgatgcttctaatcaggctcttttctgagttatcagaccagtatgtcagaaccggcgtaatcattggggcaatatggcttatcatcaactggattcttgatcttggcatcctcctctctttaaacggcatggacatccccacctatgtcagggagatcgggcttcggtatctcatgatctttatcatgagcgttatggccggatatatcgcagagaatgcaaccaataagacctaaataagaccctaaatcagaaaatagctaaatgagggtatgtggatcaggatcacgccacccgaatccctgcagttctgtccaagggtatatcatatccaaaatacccctgaataaagcccggaacaccccatttttataaaggatagtgcagggggacacaaagccttcaaataattctttattttacaaaaaggacctaaatcacagacatatagcaggccgctattcgcatgcaaaaatagggggcaccaatgttcggcccagagagagatcgggcaatagcgagccactatgtgaagattattttaagtgcgttaaacgtgcctttcaaaaaaagagcctatttaagcaccttaaacgggaaacgggagtcccgtgtattttcccaccctgtcatccatcatctcttcacaacaatgagcgttagatcatcagactggggtgctgtaccagcaaatgtccgaaccgccagaacgattgcctgcatcagtccttctgcagaagagagatggtgctgctgtatcacttcgtacagccgttcttcagtgaataacttcccatcaggatccatcgcttcagtcaccccgtctgaatagatgacaagcacatcaccgggtgagagtgtgactgaaccctcagaataatcaggatcgtccaaaagaccgatcaccggaccggttggttccagagttgaaaggttcctctcagccctgtacaggacaggagggttatgtcctgcattgacataccggagtatacatgattgagcatcaaggactccgaaaaacagggttacaaaactcactgaaccggagtcctcgataaagatggagtttgatgaccggattatacctgccggggagccgggccagcgggtgagtatcctgatgatggtccgggagagtgccatgaagagagcagcgggcaccccttttcctgcaacatcagcaagcacaagggtgactgaggtatcatgccttgaaaagatatcataaaaatccccaccgacttcaagagccggaatggttatcgcagcaatatcaaagccttccggaaccggaaatgatgcagggatgatcgattgctggatcttcgatgcaacaagcatctctgaacgttttcgttcaatctcctcactgtactccttgatcttttggatcatcaggttcatgctggtctcaagttcggtaaattcaagggtgtgcatgcttctgattgtatgatccaggtccccgtctgctatctggtgcacgtcggtaacaatctcccgaatcggagctgaaatacgcttagataccaaaagtgccagaattatacctgaaccgatccctacaattccaaacaggatatactgaaacagcagcatctcaagctgttctttcagccggtctccgtacctgatcaccgcgacgatactatcatcagacagtgcctgtgggtttttcagatcgatgaataaaatggtggtgcgatccccctgtaccggggagccaaatgatgtacctgatcgtgacctgagagcttgtgtgatatcatcggaggggagggggattacctcttcagagatattctgatctgaactccagaccgcgacccggtttccccagatatcatagatctcaagaacatcaatatccgggttttcatcccatatccgtccgaccatatactggtacgagaattcagacctgatatctgcaaaagcatcagataaaagaccaatctcaagaacataccggtgatcaggagtcgggatgtatgcaaacttcctgagatctccaaggaccttgagatcactctgattctgaacagatctgaccacccgatccatggccggggtgctgcctttcatgtgctgtttgagtgcactataaaattcagggtaatttttgaagtctaccccctttactgcaggctctgtcgtatacaaaatgatcccgtcctcattaaacacatagagatcaaccgttgcatttgtctgctgactgaaccgttctttcagcgagaaaagatccatcgccccaggatcctgaccgcttctcgtatactcttcaagataggtagagagcatctcttccataaccggatttaaagaactgtcaatcagatccagtcccttatttaccagctgaaccgattcgatcaacgtatgctcagtatatgcctctattatggcatgttccctgatgacatcctcagttgccctgatataactgatcggtaatactccggcaagaacgagggcaataatgagaatgatgtaaaaaatgaggtattgccggatggatacaatcataaaaacgactcaggaaccctgaaccgggatgatatcagttaccggtgcaatcgcaatggtcgcacttctgatcatggtgacgcctaaaagccggtgcatcgccaaaagggagcctttcaatagtccatcggttatccgggcctccatatcagattcaggattccacgggatatcatgcatcacggctccacagaggtgtgcgtagagctgtgagggatgagacggggttggaagaagggtaattcttttcagaagatcttcaggaaacttttccctggcttttggaatatccacgatgtatccgcatccaagaagggtttcgccacggtactgtggatcaagcacatcgacggagacagtatccaggagattatccttccttggaatataatagagtgacttgtgctcttcagggcgggtcccttctgactgcttcttttctgctgccctgacgagtgaggaagtaatgtcagagctgcacactccttcaatacctgcctggaaggtgacgaagcagatacccccccatgagggccaggttttctctgcaaaccggaatatttcttcatacagggtctgcaggctgaccggttttatgaggttttcaatcgtcagaacagcatgcatcgaaccgtcataggatacctgaaaaagccctgactggacgagatcaccggcctctatgatatcgctggtaatgaaatcaggagtcttgttcccgtccgccggcacccagatgacagaaccggataactccatcatctcaccggcaaggtcagagatggtcgatccatcagtacctattgcaccaatacctacactataccgacccttttcatagggaattttcatgaaatcctgcaccattacctctccggcagcaacccgtgaaatattccccctgaccttgagatgaaccggacctgtggtcaggtgtgttgcagtaaaaatgccatttgtctctgcattacctgccggtctggtactactatgggtcagtgcttcatgcagtgtggggtagatctgaaatgcctgaagaaaaccacccatcttcagaactttctgggtaaattcaccaacctgacagagagaaaccgttcctttgcgttcatggatcttccggtaaacttcctgaaacacccggagacctgctgaactgatataatcgaccccgccaaggtcaaaaattatctcccgatcactctcgcggagatcatttcggatcgcctccgctacctgctgggcaccaaatccatccattcttccggataaaataagcgtgagcggaccttctgatctctgtattgaaatatccatactcattctgagtgggattttaacatgccttctataaaagagtacgtttttttagacggggatattttgaagaagaaaaacaaagtaaaatgaagtcacatgctcacaaaagatctgctggagataatctctcatggtgagaactcaggggtcgagttcaagcgagatgatgtgagacctgagcaacttgcgaaagagattgtggctcttgcaaatcatcgcggcggtatgatcctccttggtgtagaggatgacggaaccatcagtggagttcagcgtgataatctggagacctggatatttgacaccgtttttggacggtacgtccaccctatgattcttcccttttatgaaacggtccggattgaaccggggaagcaggttgcagttatatcgtttcctgaaggcacgtcaaaaccgtatgttctccgaaataatgaccgggaagagatctatatcagggctggttcaacctcaagacttgcgacccgtgaacagcaggcacgactgtttgctgccggggggattttacacactgaactcctcccggttccgggaacctcattccagtcccttgaccttacccgaatccgggaatatctcactcatattatccatgatccggagattcctgacaaagatgaagactggatacgaaggctcaccggacttgggatgctcacgaccgtctctggagacagagttgtctgcaccattgccggcattgttctcttcgggatacacccacggaaatatatgaggcaggcaggaatccgccttatcatatacgaatcagaagagaagacctaccagacattcgttgataccgtacttgacgggccatgtaccggacgatatatcacaaatgaacacggagtcagaacactccaggacccaggtctcattgaacggttcagcgagatgattatgccatttatctcaaccggtgcgagcacagtcaatgatgagttcagactgacaaaagactggcaatacccctttgaagcaattcgtgaagtggtcatcaacgccctctgccaccgggactggacacgggcagttgatgtcgaagtaagcagatatagtgacaggattgagatcatcagccctggtgctcttccaaattccatgaccgtagagaagatgattgcagggcagcggtctccacgaaatccattgatagtggaaatattacgtgactatgggtatgttgagagtagggggatgggtgtcagaaccaaggtgattccgctgatgaagatgaataataacagagagccggtctttaaggcaactgaggattatctgtgtacagtcttataccggaaatcagaataatcctcatcacacacgaaaaaaagttaattggaataatctggtcttccaagttttggctcaaatgcgagatcggcctcactcctgatggcatgagagaataaggccagtgggatatccatggcacagagttcctcacactgaccacagttgacacatgagtctgaaatatgggcaaaccgtctcatatggaacatgggtgacgggggcaatgcaccctgctcgaccatgagtgatttcgtctccgtaccattccctgcgactggcatacagaccggacagttctctatacaggagtagcatttgatacaccgggaggtctcatcagcaattgtattccagagatcagacctgagtgcagtaaagtcctttttccgccatttctgacctagctttatcatggcaccctcaaccttctttctgatctcaattcctttaggatcagcaggagttgttgctattacaccggattttacggctttttgcaaaagatctgcacctttatcactgcagacctcaacaaaggtggctttcccggccttatcaccgatgacaccccagttaccacaggcaagatctgcctcacggggtactttatagagacaccgacggcagttggaccggcgtccatacccgctctcttccagttcatcaatggagattcctttatgcccaccttcatactcgatgataaactggcccttgtcaatctcctccttgtgaactgtatttggatcaacctggtatacatcccgtatcatagacctggccttgaccggtgagaccgtcccaccacagttcaccccgatgagcaacaggtttgaaagattgactcctttgcgttttgccagctcatggagagccataaggtcacagcctttaacggtaacggcaagcttcttgtcaggtgagcctttctggaacttctggaccactttcgcgatcaggagtgtcccgcagtgcaaagacccggcagtaccgaccagctcctttggatcggtgacgacggttgggactgcatcatagatatcctgccctttctgcacggcaagaaccgcatcaaccatcttgttggtaagggcatattttaaaaggccagtaacagcaccaccacactctgctttttgtgcgatctgatcctcaagtgtccatgcataaaccatatcaccaacctttatggcaggttttgagtcaaaaagtcccatttatttcgcctccgcaatcttctctatcttcaccgcacaggccttggactcaggaatttttgcaatcgggtccagagcattgatggtcaggacattcgcggcgcattcagcatagtggaacgggatgaagacgacaccaggcatgatatccggtgtcacccgtgcagggatggtgatctctccccgtcttgtttttgcttttaccttctctttgtctgcgatacccagtttctttgcatcctctgtgtttatctcaacccatccggtcggttcttcacgctcaaggcttgcagaccgccgggtcatggtaccggtatgccactgccagatggaacgtccggttgtcagcacaaacgggtattcactgtccggaacttcctggggccatttgaaggggataccagtcatgagaccctttccatccggcatgccaaacttctcagtatggagaatcggtgttcccggatgatccgtcgttggacatggccagtgaagtgcttcaggccggttcagacgctcataggtcattcctgcgtatgacggggtgagagatgccatttcattgaatacatcttctgaagtcttccatggaaactgggcaccatatcccatctttgctgcgatggatgctattatctcccagtcaccttttgcttctccaggtggattctgtgcttttcgccacatctgaaccctgcgttcggttgaagtctgtgtcccgtccttctctgcataacaggcagccggaagaactacatctgcaaattcggccgtctcgttcaggaatatatcctgaacaacaaggaaatccagagtttttaatgcatgctcgacatgggtcaggtcaggatctgatatcatcggattttcacccataatatacaggcactttatctcaccgggtttttcagtgaggacattcataagtgttgtgacttcgtatccgttctcaccctttgctattccatccggaaacttccagccatctgcaaacttcttctgggctgcctcatcgatgaccttctggtatgccgtgtaaaccaccggaagacatcccatgtcacaggcaccctgcacattattctgtccacgaagggcattcacaccagtccccggccgcccgagatttccggtcagcatctgcaggttgccacaggacttgacattgtcaacaccggtggtgtgctgggtgatacccatggagtacagaattgcacttgcccctgactttgcaaaccattctgctgcagtttttatcttgtcagccggaacaccagtaatttttgagacattctcaaggctgtagtcatccttcatgacctctttcttgagttcgtcaaatccattgcaacggttttggataaactccttgttttcccagccgtttcgtatgatctcctgcatcattccgttcagcagagcaacatcggtaccggacctaaactggagatacagatcagcctgttttccggtgggagtgtacctgggatcggcatagatgacctttgcacccttcgcctttgcctgcataacccggcgcccgataagcgggtggcattcaaaggtgtttgacccgatgatgaacacacatttggattctgcgatgtcgccaatcgagtttgtcatcgcacctgacccgaagatattagcaagtcctgctaccgtggaagcatgacacaggcgggcacagtgatcaatgtgctttgtcttgagcaccccccgggcaaacttcatcatggcgtagttgtcttcgtttgagactctggctgaggcaagacaggcacactcatctggtttataagacttgaacttttcagcaacaagtttgagtgcttcatcccaggaagcttccacgaatttcccatctttttttatgagtggttttttcaaccggtccgggttgttaataaactcgtgagcataagtccctttcgggcatagttttccttcattcaccggagaacgctgatagggtgcaaccccggtcacaatccctttgtctacgaccagattaaatgaacatccggttccgcagtacgggcaggtcgtctgaacatacttcataaattccctcttatggatgctgtaggcta

SEQ ID NO: 6223 - protein, 56 aa, Streptomyces coelicolor
LRDYVVTERLLENFDEALALIKSSLDGHRSKAAYLHGSFGSGKSHFMAVLYALLSG

SEQ ID NO: 6224 - protein, 57 aa, Bacillus cereus
LDEYVVTNELLHHMGEFFKSYKKGITGHTDKMGVWISGFFGSGKSHFLKILSYLLEN

SEQ ID NO: 6225 - protein, 259 aa, Thioalkalivibrio sp. K90mix
  MISC_FEATURE (1)..(259): hypothetical protein TK90_1127 [Thioalkalivibrio sp. K90mix]
MKIETSGFKGAQRGGAHTARTMMLAELSELLDYCGESAVAPADFRQAIEENNCLGKRSAKSRTLTYRHLVDLYGLSDAQLVFRGLRYFWNKDPDGRPLMALCAALARDRILADVAPRIWAAEPGALVTREWVEEQIEVLDPGRFSPATRKSVAQNINATLTQSGHLRGRMKKYRVTAQPTSGAVAYALLLSRASGALGPALFQTLYAKAMDCVIEDAIVLAEGASRRGWMRFKRLGEVMEVAFPDIANATDLERLHEQD

SEQ ID NO: 6226 - DNA, 780 bp, Thioalkalivibrio sp. K90mix
  misc_feature: hypothetical protein TK90_1127 [Thioalkalivibrio sp. K90mix]
ttgaagattgagacgagtggcttcaagggggcgcagcgtgggggtgcacatactgcccgtacgatgatgctggccgagttgagcgagctgctggattattgtggcgagagcgcggtcgcgccagcggatttccgacaagcgatcgaggagaacaactgcctcggtaagcgctcggcgaaatcgaggacgctgacgtatcgccatctggtggatctctacggtttaagcgacgcacagctcgtctttcgtgggctgcgctatttctggaacaaggacccggacggtcgcccgctcatggcgctctgcgccgcgctggcccgcgacaggattctggcggacgtcgccccgcgtatctgggcagcagagcccggtgcgctcgttaccagggagtgggttgaagagcagatcgaagtgctggaccctggacgtttcagcccggctactcggaaatccgtggcacagaacatcaatgcgacgctgacgcagtccggccaccttcggggtcggatgaagaagtatcgcgtcacggcacagccgacgtctggcgctgtcgcttacgcgttgttgcttagccgggcctctggggcgcttggcccggccctgttccaaacgctttacgccaaggctatggactgcgtgatcgaagatgccatcgtgttggccgagggtgccagccggaggggctggatgcgcttcaaacggctcggggaggtcatggaagtggccttcccggatatcgccaacgccaccgacctggagcggttgcatgagcaagattag

SEQ ID NO: 6227 - protein, 183 aa, Thioalkalivibrio sp. K90mix
  MISC_FEATURE: hypothetical protein TK90_1128 [Thioalkalivibrio sp. K90mix]
MSKIRQLLQNYGDHIAVPWREDAAPAQRVIFCVYRETDERTLRAKVDEFDLVTREAGYDWRHFDLTDTFACWLSGQRYAKKYFAQPELLANLLPRYLDYLGECFERFVAEQGAHTRSVVAVSGVGSLFGLVKVKDVVDRFAPLVNGRLLVFFPGSFENNNYRLLDGYDGWNYLAIPITADKTH

SEQ ID NO: 6228 - DNA, 552 bp, Thioalkalivibrio sp. K90mix
  misc_feature: hypothetical protein TK90_1128 [Thioalkalivibrio sp. K90mix]
atgagcaagattaggcagctcctgcagaactacggcgaccatatcgcggtcccctggcgcgaggacgctgcgcccgcccagcgcgtcatcttctgcgtctaccgcgaaaccgatgaacgtacccttcgagccaaggttgacgagttcgacctggtcacgcgcgaagccggttacgattggcgccacttcgatctcaccgataccttcgcatgctggttgtcaggccagcgttacgcgaagaagtacttcgcccagcctgaactcctggccaacctgttgccgcgctacctggattacctcggcgagtgctttgaacgctttgtcgccgaacagggggcccacacccgcagcgtcgtggcggtgtctggtgtgggttcgctctttggcctggtgaaggtgaaggatgtcgtggaccgctttgcgcccctggtgaacgggcggctgctcgtgttctttccgggcagcttcgagaacaacaactaccgtctgttggatggctatgatggctggaattatctcgccatcccgatcacggctgacaagacgcattaa

SEQ ID NO: 6229 - protein, 1145 aa, Thioalkalivibrio sp. K90mix
MQNREIYQKDPSTRNLANNGVANVNDDTSGSALDVLRYELETFVCDGEYERGVAHILDTYLKNLGHEEQPAVWISGFYGSGKSHLAKMLRALWLDTPFPDGATPRGIAHLPPSVQEHLTELTAQGRRHGGLHAASGTLGAGASGSVRLALLRIIFKSVGLPEGYPYARFVMWLQHEGVLEKVKAAVEAKGYDWEEELDNFYVADGLHEALTELMPKRFASQSACVETLNNMFPNVKDVSSTEMQDAIEQALTHDGKLPLTLVVLDEVQQYIGPDAQRSQDVQEAVEACAKYLKAKLLFVGTGQTAITGTANLARLQGRFTVRVQLSDADVDTVIRKVILAKKPEVTDTIDQVMNTNLGEISRHLTGSSIAHNQDDREYFVQDYPILPVRRRFWETALRVLDQTGTDSQLRNQLQMVHKAIQSNLDAELGNVVRADYIYFDGAEKLLQARMLPKKVYEAIQTWSRGSADEQLKARACAMIFLINKVVSGQPQIGIAPTVDTLADLLIEDLPAGSASLRSKLPKLLDDCHLVMKVGEEYRIQTEESTAWNDAFLNHRSNIANQQHVVEDERDRRIRKMFGDLSRRLSLQQGQSNVSREVESCFDAELPKDAHSRIYLWVREGWSSDENSVRAEARQAGSGSPTVFVFIPKRHGDELREQFMEYKAAKYTLDERGAPSTPDGKEAREAMETSMRHAEGRIDGLLKECFAEARVFQGGGNEIGGNDLLAMMQEAAEAAQIRLYPKFDAADHPAWGKVLEHAKKGAPDALKAVGDEGEPDKNPVCKEVLGFIAGGKSGADIRAHFEGPPYGWSGDAVDGALHVLMVSGHARAQDDRGNPMDPASLDRRAIGKTQFRVESATITTAQRIQVRKLMQPLGIKAKSGEELSYVPQFLEALRELAATAGGEAPKPEPPDSGFLNELRRCVGNEQLQAIYNQRETIAESIKEWQATRDKIQERWPQWLTVKQLARHAEALDSTEALRSQVESLEQHRKLLADPDPCTELANNLAQGLREELNRLDAAYKTEHETGMARLSADANWQALEPEQRNSLLAAQRLTNADAPEIKVQTTADVLATLDRIPLGTLADRVAAMSGRFGQILEEAALLREPEVQFVNLPRPTLQSEAEIDKWAEEAKDDLKRCLANGPVIPR

SEQ ID NO: 6230 - DNA, 3438 bp, Thioalkalivibrio sp. K90mix
  misc_feature: hypothetical protein TK90_1128 [Thioalkalivibrio sp. K90mix]
atgcaaaaccgggagatctaccagaaggatccgtcgacgcggaacctcgccaacaatggcgtcgccaacgtcaacgacgacacctcggggtcggcgctggatgtcctgcgctacgagctggaaaccttcgtttgcgacggcgagtacgagcgcggtgtcgcccacatcctggacacctaccttaaaaacctgggccacgaggagcagcccgccgtctggatcagcggcttctacggttccggtaaatcgcacctcgcgaagatgctccgtgccctttggttggataccccctttccggacggcgccaccccgcgcggcatcgcgcacctgcccccctcggtgcaggagcacctcactgaactgaccgcccagggccggcgccacggcggcctgcatgcagcctccggcacgttaggagcaggggcgagcggcagcgtacgcctggcgctgctgcgcatcatcttcaagtcggtcggtctgccggaaggttatccctacgcccgtttcgttatgtggctgcagcacgaaggtgtgcttgagaaggtcaaggcggccgtggaagccaaggggtacgactgggaagaagagctggacaacttctacgtcgcggacggcctgcacgaagccctcaccgagctgatgcccaagcgctttgcatcgcaaagcgcctgcgtcgaaacgctcaacaatatgtttccaaacgtcaaggatgtctccagcacagagatgcaggacgccatcgagcaggcgctaacccacgacggcaagttaccgctgacgctcgtcgtgttggacgaggtgcagcagtacatcggccccgatgcgcaacgctcccaggacgtgcaggaagccgtcgaggcttgcgccaaataccttaaagccaagctcttgttcgtcgggaccggccagaccgcgatcaccggcacggccaatctcgcgcgcctgcagggccgtttcaccgtccgggtgcagctctccgatgcagatgtggacacggtcattcgcaaggtgatcctggccaagaagcccgaggtcaccgacacgattgaccaagttatgaacaccaacctgggcgagatctctcgacaccttacgggcagctccattgcccacaatcaggacgaccgcgagtacttcgttcaggattaccccatcctgccggtgcggcgccgcttctgggaaaccgcgctgcgcgtgctggaccagaccggcaccgacagccagctccgaaatcaactccagatggtgcacaaggccattcagagcaatctggacgcagaactcggcaacgtcgtgcgtgctgactacatctacttcgatggcgccgagaagcttctccaggcgcgcatgttgcccaagaaggtctacgaggccatacagacctggtcgcgcggcagcgcggacgagcaactaaaggcgcgcgcctgcgcgatgatcttcctgatcaacaaggtcgtcagcggccaaccgcagattggcatcgcccccaccgtggacacgctcgcggatctcctgatcgaggacttgccggccgggtcggccagtctgcgtagcaagctgcccaagctgctagatgactgccatctggtcatgaaggtgggcgaggaataccgcatccagaccgaagaaagcacggcctggaacgacgccttccttaaccaccgctcgaatatcgccaaccagcagcatgtggtcgaggacgagcgcgatcgccgtatccgcaagatgttcggtgacctatcccgacggctaagccttcaacaggggcaatcgaatgtcagccgcgaggtcgagtcttgcttcgatgcggagctccccaaggatgcccatagccgcatctatctctgggtgcgcgagggctggtcgtccgacgagaactccgtacgagccgaggcccgccaggccggcagcggctcgcccaccgtcttcgtcttcatccccaagcggcatggcgacgaactgcgcgaacagttcatggagtacaaggccgccaagtacaccctggacgaacgtggtgcgcccagcacgccggacggcaaagaggcgcgtgaggccatggagaccagcatgcgtcacgccgaaggccggattgacggcttgctaaaagagtgcttcgccgaggcccgcgtcttccagggcggcggcaacgaaatcggcggtaatgacctgttggccatgatgcaggaggcggcagaagcggcccagattcgcctctacccgaagtttgatgcggcggatcatcccgcctggggcaaggtcctggagcacgccaagaagggcgcgccggatgccctcaaggctgtcggcgacgaaggcgaaccggacaagaaccccgtgtgcaaagaagtgctcggcttcatcgcgggaggcaagagcggtgccgatattcgcgcccatttcgagggcccgccttatggctggtccggggatgccgtcgatggcgccctgcatgtcctgatggtttcagggcacgcgcgcgcgcaggatgatcgcggaaacccaatggatccggcgagcctggaccgtcgcgcgatcggcaagacccagttccgggtcgaatccgccactatcacgacggcgcagcggatccaggttcgcaagctcatgcagcccctgggcatcaaggccaagtccggtgaggagctgagctacgtgcctcagttcctggaggcactgcgcgagctcgcggctaccgcaggcggcgaagcccccaagccggagccgccggatagcggctttctcaatgagctgcgccgctgcgtgggcaacgagcagcttcaggccatctacaaccagcgagagaccattgccgaatccatcaaggagtggcaggccacccgcgacaagatccaggagcgctggccgcaatggctaaccgtcaagcagctcgcccggcacgctgaggcgctggacagcactgaggctctgcgctcccaggtggaaagcctggaacagcaccgcaagctcctcgccgatccggatccctgtacggagctggccaacaacctggcccaaggcctgcgcgaagaattgaaccggctcgacgctgcctataagacggagcacgaaacgggtatggcacgtctgagcgcagacgccaactggcaagccctggagccggaacagcgcaatagcctactggcggcccaacgtcttaccaatgcagatgcaccggagatcaaggtgcagaccaccgctgatgtcctcgccaccctcgaccgcatcccactcggcaccctggccgaccgcgtcgccgccatgtccggccgcttcggccagattttggaagaagccgcgcttctccgcgagccggaagtgcagttcgtcaacctcccgcgccctacattgcaatctgaggccgagatcgacaagtgggctgaggaagcaaaagacgacctaaagagatgcctggcgaacggcccggtgattccgagatga

SEQ ID NO: 6231 - protein, 1174 aa, Thioalkalivibrio sp. K90mix
MHTLNPDLRKQLEITVVDARELAEKAARAALEELGVGEGTPYPHLTEGQRDLRRRLRLHGRQLGDPLNGGKEQSMERLVEEVAYEHWHRMLFARFLAENELLMYPDPEGAVPVSLQDCEDLAADEGAANGWELAARYAAQMLPQIFRVDSPVFELKLPTNFQQPLERLLAELPAEIFTASDALGWVYQFWQTNNKERINRSEVKIGARELPAVTQLFTEPYMVSFLLDNALGAWWAARRLTEDDLRNAESEEALRQKAAIPGVPLQYLRFVREETYAVDGQAGDDQPEGGAGQGAWTPAAGTFVQWPQNIADMKIMDPCCGSGHFLVAVLLMLVPMRQELEGLDPQQAVDAVLRDNLHGLELDQRCVELAAFALALTAWRYPGTGGYRKLPEIQVACSGLSVSVAKDEWKQLGLGRKNLSIALDWMHDAFRDAPVLGSLLNPAKTDAAKVVQWSELSSVLDGALSQERTDAQQEAAVVAQGLAKAATLLAGQYTWVVTNVPYLSRGKQSERLRDFCEKHYPAAKNDLATVFLDRCLELCAEGGSSSVVLPQNWLFLSSYKKFREKLLKQEAWNLIARLGEHGFDSPQAAGAFVAMLTLTRGNATSQHGALFSGETVTQRIRGVDVSEPRTAADKAAALLGAEVKSVDQAGQLENPDARVSLEDLETGSILSDSVNSFLGLGTGGFEQFGRSFWEFDRRPSDWALLQTAPQNRADFDGLSSLVAWEKNSNRVKGMDRLYRERIHNQDQSGQQAWNKSGIGVALMRGLRCSLYTGAKHDKSMAALIPTDESIIAAVYAYCKSTDYYERVREIDQNVIVANGTLVKVPFDLERWTQVAAEQYPHGLPKPYTDDPTQWIFHGHPSGSVVWDEDSKRTAHGPLRTDDTVLQVAVARLLGYRWPAELDPEMELAAEQREWVERSEALLPHVDRDGIVCIPPVRGEGAAEDRLLGLLAAAYGDEWSGQVQANLLASVGHAGKTLESWLRDKFFAQHCKLFQNRPFIWQVWDGLRDGFSALLNYHRLDYKNLETLIYTYLGDWIKRQKQDISSGVDGAQERLAAAEALKERLLLILEGEKPHDIFVRWKPLAEQPIGWNPDLNDGVRLNIRPFVYVPDIKVKDAGILRDRVTTRDLKTKQLKFWKKDRGKDVESAPWFDTFGGERINDHHLTLAEKRAARGV

SEQ ID NO: 6232 - DNA, 3525 bp, Thioalkalivibrio sp. K90mix chromosome
atgcatacacttaatccagacttgcgcaaacaactcgaaatcacggtggtggatgcgcgcgaactggccgaaaaggccgcgcgcgccgcgctcgaagagctgggggtgggcgagggcactccgtatccgcatctgacggagggccaacgcgacttgcggcgtcgtttacgcctgcatggacgacagctcggcgatccgttgaatggcggcaaagagcagagcatggagcgcctcgtcgaggaggtcgcctatgagcactggcaccgcatgctgtttgcgcgcttcttggcggagaacgagctgctgatgtacccggacccggagggtgcagtgccggtgagcctgcaggactgcgaggacctcgccgccgacgagggcgccgccaacggctgggagctggccgcgcgctatgccgcgcagatgctgccgcagatcttccgcgtggattcgccggtcttcgagctgaagctgcccaccaatttccagcagccgctggaacgcctgctggcggagctgccggcagagatcttcacggcctcggatgccctcggctgggtctatcagttctggcagaccaacaacaaggagcgcatcaaccgctcggaggtcaagatcggcgcgcgcgagttgccggcggtcacgcaactcttcaccgaaccgtacatggtcagcttcctgctggacaacgcccttggtgcctggtgggcggcgcggcgcttgacggaagacgacctgcgtaacgccgaaagcgaggaagcgctgcgccagaaggctgccatccccggcgtgccgctgcagtacctgcgctttgtgcgcgaggagacctacgccgtggacgggcaggccggcgatgatcagccagaaggtggtgccgggcagggcgcatggacgccggcggccggcaccttcgtgcaatggcctcaaaacattgcggacatgaagatcatggacccctgctgtggctcggggcacttcctggtggcggtgctgctcatgctcgtgcccatgcgccaggaactggaagggctcgacccgcagcaggctgtggacgccgtgctgcgcgacaacctccacggtctggagctggaccagcgctgcgtggagctggccgccttcgccctggcgctcaccgcctggcgctaccccgggacgggcggctaccgcaagctgccggaaatccaggtggcctgttccggcctctctgtcagcgtggccaaggacgaatggaagcagctcggactgggccgcaagaacctctccatcgcgctcgactggatgcacgacgcctttcgcgacgcgccggtgctgggcagcctgctgaatccggccaagaccgacgccgccaaggtcgtgcagtggtcagagctgtccagcgtgctggacggggcgctcagccaggaacgcaccgacgcccagcaggaagccgccgtggtcgcccagggcctggccaaggccgcgacgctgcttgccggccagtacacctgggtggtcaccaacgtgccctatctctcgcgcggtaagcagtccgagcgcctgcgcgatttctgcgagaagcactatccggccgccaaaaacgacctggccaccgttttcctcgaccgctgcctggagctatgcgccgagggcggcagcagcagcgtcgtgctgccgcagaactggctgttcctcagcagctacaagaagttccgggaaaagctgctcaagcaggaagcctggaacctgattgctcgccttggcgagcatggtttcgattcgcctcaggctgcaggggcctttgttgccatgctcaccctgacccgtggcaacgccaccagccagcacggcgcgctcttttccggcgagacggtcacccagcgcattcgcggcgtcgatgtctctgaacccagaaccgccgccgacaaggctgccgcgctgctcggcgctgaggtcaagagcgtggatcaggccgggcagttggagaatccggatgcgcgggtttccttggaagatctggagaccggcagcatccttagcgattcggtgaacagttttctcgggcttggcacaggcggatttgagcaatttggccgctcgttctgggagtttgaccggaggccatcagactgggctttgttgcagacagcgccacagaatcgcgcggactttgatggtctgtcctcattggtcgcttgggaaaagaactccaatcgcgttaaggggatggatcggctgtaccgagagcgaattcacaatcaagaccaaagtgggcagcaagcttggaataaatctggcattggggtcgcgcttatgcgtggtctccgatgttcgctttatactggagcaaaacatgacaagtcgatggcagccttaattccgaccgacgaatcgattatcgcggctgtctacgcgtactgcaagtcaacggattattacgagcgagtcagggaaattgatcagaatgtgatcgttgcgaatggaaccctagtcaaagtccccttcgatctcgaacgctggactcaagtcgccgccgagcaatatccccacggcctaccaaagccctacacagacgaccccacccagtggatattccacggccaccccagcggttcggtcgtctgggatgaagacagcaaacggacggcccacggtccactccgtaccgacgataccgttctgcaggtcgcagttgcccgtctgctcggttaccgctggcctgcggagctggatccggagatggagctggccgccgagcagcgcgagtgggtggagcgcagtgaagcgctgctgccgcatgtcgaccgcgatgggatcgtctgcatcccgccggtgcggggggagggggccgctgaggaccggttgcttggtctgctggcggccgcctatggcgatgagtggtccggccaggtacaggccaacctacttgcgagcgtcggccatgctggaaagaccctggagagctggttgcgggataagttcttcgcccagcactgtaagctcttccagaatcggcccttcatctggcaggtatgggacggcctgcgcgacggcttctcggccctgctgaactaccaccggctggactacaagaacctggagacgctgatctacacctacctcggcgactggatcaagaggcagaagcaggacatcagcagcggcgtcgacggcgcccaggaaaggctcgccgccgcagaggccctcaaggagcgcctgctgctgatcctggaaggtgagaagccccacgacattttcgtgcgctggaagccgctggccgagcagcccatcggttggaaccccgatctgaacgacggcgtgcgcctcaacatccggcccttcgtttatgtacccgacatcaaggtgaaggatgcgggcattctccgcgatcgagtgacaactcgtgatttgaagacgaagcagctgaaattctggaagaaggatcgcggcaaggacgtcgagtccgccccctggttcgacacctttgggggcgagcggatcaacgatcaccatctgaccctggccgagaagcgggcggcgcgtggtgtgtaa

SEQ ID NO: 6233 - protein, 786 aa, Thioalkalivibrio sp. K90mix chromosome
MSEQQAGQQSQTVAEALVAAVRRSARYNPDVESAPHCILWTDREQQWQSVIPALQGDMPELLVFGEYEPERRRGPAIWLRCAMAGTLDEITLPPGQTPVIYLPGVGRQDLRAVESCPESLKPLAELQYRGVTSAQINTKDWTVLAFLKSEQGGLGLDVAQDQDSKRAMLLALSNLIDEDVALLRDKRLDANYFNTLLTGGDPTRDLLQWLEDPEAFDAARTDQEKAAFAEVCRSQFAFNVQDGPLAAADLLAKGQGPWANVWQRFCESARRYPNIPKQIRRCQAPAFDLGDDAQTMGGWPQWNDHEEEELQKGLLALQQKAPHQAREQILSLDRQHAQRRNLVWAELGEAPLACALQHLATLASVTGDSLAAGSLDDLAAAYASQGWRADDAVMRALEHASSNPDYEAITAAVRAVYLPWSEDAARYLQKIVSQVTPPGGTREDDPPPYICKDQCVLFVDGLRFDTGKRLTERLESAGFEVEEDPTWTALPSVTATGKAAVSPVRDQITGAPGSTDFEPNVRESKVRLNSYHLRKLLGQAGWEYLKGHETGAGQGQAWCEFGDIDHEGHSRGWKLAMHLDGMLDEIRERIEELLAAGWAEVRVVTDHGWLLMPGGLPKIELPSALAETKWGRCAAIKQGAKTVERLFPWYWDPHQEFALADGIACYKRGEDYAHGGLSLQECLTLQLAVRHGTQSHTAATISDVGWKGLRCTVAVEGGAEGWKADIRQRAGDSASSIVNAVRPFKENGTCSMLVEDDSLEGQTATLVILDEDGQLLQQRDVVIGGT

SEQ ID NO: 6234 - DNA, 2361 bp, Thioalkalivibrio sp. K90mix chromosome
atgagtgagcagcaggccggtcaacagtcgcagacggtggcggaagcgctggtggccgccgtgcggcgcagcgcccgttataacccggatgtggagagcgcgccgcattgcatcctctggacggatcgcgagcagcaatggcaaagcgtgatcccggcactgcagggcgatatgccggagttgctggtcttcggtgagtacgaacccgagcgccgcaggggccctgctatctggctgcgttgtgccatggccggcacgctggacgagatcaccttgccgccgggccaaacgccggtgatctacctgcccggcgtggggcgccaggatctgcgcgcggtggagagctgtccggagtcgctcaagccgctggccgagctgcagtatcgcggtgtgacttcggcccagatcaacaccaaggactggacggtgctggccttcctgaagtcggagcagggtgggttgggcctggatgtggcccaggatcaggacagcaagcgggccatgttgttggcactgtccaatttgatcgacgaagacgttgcgctgctccgcgacaagcgcctggacgccaattacttcaacacgttgctgacaggcggtgacccgacgcgcgatctgctgcaatggctggaggatccggaggccttcgacgctgcccggaccgatcaggaaaaggcggcgttcgcggaagtctgccgttcacagttcgcttttaacgtacaggacgggcccttggcggccgcggatctgctggcgaaagggcaggggccgtgggcgaatgtctggcagcgcttctgcgaatccgcgcggcgctaccccaatatcccgaagcagatccggcgctgtcaggcgccggcattcgacctgggcgatgatgctcagacgatgggggggtggccgcagtggaatgaccacgaagaagaagagctgcaaaaagggctgctggcattgcagcagaaggccccccaccaggcgcgggagcagattttgtcgctggacaggcagcatgcgcagcggaggaatctggtctgggcggagctgggtgaagcgccgctggcctgtgcgctacaacatctcgcgacactggccagtgtgaccggagattcgctggctgccggttcgctcgacgatctcgcggcggcctacgcgagccagggctggagggccgacgatgcggtgatgcgggcgttggaacacgcctcaagcaatccggactacgaagccattacggcggccgtgcgcgcggtgtatctgccctggagtgaggatgcagctcgatacctgcaaaagatcgtgagccaggtcaccccgccgggcggtacgcgtgaagacgatccgcctccttatatttgcaaggatcaatgcgtgctctttgtggatgggttgcgcttcgatacgggcaagcgactgacagagcgcctggaatctgctggtttcgaagttgaggaagatccgacgtggaccgcgttgccgagtgtgactgcaacgggcaaggccgcggtgtccccggtgcgggaccagatcacgggtgcacccggaagcacggactttgaaccgaatgtgcgtgagagcaaggtccgcctgaatagctatcacctgagaaaactcctcggccaggcgggctgggagtatctgaaaggacatgagactggcgccggtcagggccaggcttggtgcgagttcggcgacatcgatcacgagggccactcccggggctggaaactcgcgatgcatctggatgggatgctggatgagattcgggagcggatcgaagaactgctggcggccggctgggcagaagtgcgggtggtgaccgatcacggctggttgctcatgcccggtggcctgccaaagatcgaactcccgagtgcgctcgccgagaccaagtggggccggtgcgcggccatcaagcagggagccaagaccgtggagcgcctgttcccgtggtactgggatccgcaccaggagttcgccttggcggatggtatcgcgtgctataagcgcggcgaggactatgcacatggcggcctgagcttgcaggaatgcctgacactgcagttggccgtgcggcatggcacgcagtcacacactgcagccaccatcagtgatgttggctggaagggactgcgctgcacggtggccgtggaggggggcgccgaaggctggaaagcggacatccggcagcgggcgggcgactccgccagtagcatcgtcaacgccgtgaggcccttcaaggaaaatggcacctgctcgatgctcgtcgaggatgacagcctggagggccagacggcgaccttggtgatcctcgacgaggatggccagctcctgcagcagcgtgacgtcgtgattggtggaacctaa

SEQ ID NO: 6235 - protein, 682 aa, Thioalkalivibrio sp. K90mix chromosome
MTVELDDIDRRAVSALDGYLVRKDLVRTFSRQFPVPTYVVEFLLGRYCASVDEEEIQEGLEIVQRQLQSRTVKAGEEELFKSRAREEGEIKLIDMITARLDTKTDTYVATLPSLRIKDARITPEMANGHERMFTGGFYAEITLGYDASIAAEQNGRPFGIEGLREIQLSSRDVLEKLGDARKQFTTEQWKNFLLRSIGIEPGSLSDREKDALMLRMVPFVERNYNLVELGPRGTGKSHLFQQVSPYAHLISGGKATVAKMFVNNANGQRGLVCQYDVVCFDEVSGISFDQKDGVNIMKGYMESGEFSRGKESIRADGSIVLVGNFEVDVEHQQRVGHLFGPMPPEIKDDTAFMDRIHAFLPGWDVPKVRKEILTDHFGLVSDFLSECWSQLRAQSRVATIQDRVRFGGALSGRDTNAVNKTISGLLKLLYPANGQVLDEDLEWAARLALEARRRVKEQQKRIGAAEFRNTHFSYVMGDDGVEQFVSTPELQSEGGIGDDPLEPGQVWTISPGTGEEYPGLFRIEANEGPGSGVKILNKPVPPAFKESMGFAEQNLYARASQLVGDKDPRQHEFTAQLRGFDAAKSGAKVGMAGLIALCTSLLKRSVRGGLIVVGEINLGGSIEPVHDAINMVELAVEKGASVVMMPVTCRKQLFDLSDDMATKVDIQFYSDARDALIKAIAD

SEQ ID NO: 6236 - DNA, 2049 bp, Thioalkalivibrio sp. K90mix chromosome
atgaccgtagagcttgatgacatcgaccgccgggcggtgagcgcccttgacgggtatctggtacgcaaggatctcgtgcgcacgttcagtcggcagtttccggtgccgacctacgtggtcgagttcttgttggggcgctactgcgccagcgtcgacgaggaagagattcaggaaggactggagattgttcagcgccagcttcaatcgcgcacggtgaaggccggggaggaggagctctttaagtcccgagcgcgcgaagaaggcgagatcaaactgatcgacatgatcacggcccgcctggacaccaagaccgatacctacgtggcgacgcttcccagcttgcgcatcaaggacgctcgcatcacgcccgaaatggctaatgggcatgagcggatgttcaccggtggcttctatgccgagatcacgctcggttacgacgcttccatcgctgcggagcagaacggccggccgtttggcatcgaggggcttcgcgagattcagctctccagccgagacgtgctggagaagctaggggacgcacgtaagcagtttacgaccgagcagtggaagaacttcttgctccgctcgatcgggatcgaacccggtagcttgagcgatcgtgagaaagacgcactgatgttgcgcatggttcccttcgttgagcgtaactacaacctggtggagctggggccgcggggcacgggcaagagccatctgttccagcaggtatcgccctacgcgcatctgatctcgggcggcaaggcgacggtcgccaagatgttcgtaaacaacgccaatggtcagcgcggcctggtttgtcagtacgacgtggtctgcttcgacgaggtctccggtatctccttcgaccagaaggacggtgtgaacatcatgaagggctacatggagtccggtgagttcagccgtgggaaggagagcatccgggcggatgggagcatcgtgctcgtcggaaatttcgaggtggacgttgagcatcagcagcgcgtcgggcatctgttcggaccgatgccaccggagatcaaggatgacaccgccttcatggaccgcatccatgccttccttccgggctgggacgtaccgaaggtgcgcaaggagatcctgacggaccattttggtctggtaagcgatttcctgtcggagtgctggagtcagcttcgcgcccagagccgggtggcgaccatccaggatcgggtgcgtttcggcggggcattatcggggcgcgacaccaatgccgttaacaagacgataagcggcttgctcaagctactctatcccgctaacggccaggttttggacgaagatctggaatgggccgcgcgtctcgcactagaagcgcggcgccgcgtgaaggaacagcaaaaacgcatcggcgccgcagagttccggaatacgcacttcagctatgtgatgggagacgatggcgtcgagcagttcgtctcgacgcccgagctgcaaagcgaaggggggatcggagacgatccgctggagcccggccaggtctggacaatcagtcctggcactggcgaagaatacccgggtctatttcgaatcgaggcgaacgaaggtccaggaagcggcgtcaagattctcaataagcctgtgccccccgccttcaaggagagcatggggttcgccgagcagaatctatacgcccgtgccagccagctcgtaggcgataaggatccgcgccaacatgagttcaccgcacagctgcggggtttcgacgctgcgaagtcgggtgcgaaggtgggtatggctggcctgatcgcgctgtgcacatcgctgctcaagcgcagtgtgcgcggtggcctgattgtggtcggcgaaatcaacctggggggttccatagagccggttcacgacgccatcaacatggtcgagctggcggtggaaaagggcgcttccgtggtgatgatgccggtcacgtgccgtaagcagctttttgatctctccgacgatatggcgacgaaggtcgacatccagttctactcggatgcgcgcgatgcgctgattaaggcgatcgccgattga
